United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 21

SEQ ID NO: 33 - DNA, 4550419 bp, Flavonifractor plautii (residues 1-1,516,807 of 4,550,419)
  misc_feature (4542384)..(4542385): ">" designating noncontiguous sequence of whole genome
ttgagtcttaattgcatatcaagtggaactttttggagggagagataatgcccacaacattgcctgtgaattatccggagatgattgttgaatagtccgaaggactaacggtatcagagaaaaagttagctgccttgggctatcaaacatttttgaggttgtggagttatccaaacccatataaactacagtcaaacggaaaagaattgtgtgatttgttaattgtatttgataaccacataatcattttctcggataaagattgcgtatatgggaactccgacgatcctaaagttgactggagacggtggtataagcgagcaattcagaaatcagcagagcaactgattggtgcaaagaattggattatccgctatccagataggattgctgtagatgcaaaatgcagccaaaaaattccattaaaaattaaaatcaccgcagaaacggaattccacttaattgcaattgcccatggcgcaacagaaccatgcaaaaagtatttttctggtggcgatggaggactcatggttgatagctgtatcgttggtaatatgcacatcaacgaggactgtgaaccattttgcattggacgagtatttaacgagcctcaggaattcatccatgtttttgatgatgtatcttacgtcaatgtacttcacgaattagataccatacaagattttcttaggtatttggaagctcgtcagaaactgtttgtgacgaagcacataattgctgagagtgagagtgagagtgatatattggctcaacatctccggggggtgatgaaaggaaattcgcacattttacaagaaatttgtaaaacacacaccgatatataccttgagggtgggttgttcgaagaactaaagtgttcccccgaatacgccgagtggcataacaaaattaagaagagctatttttgggatgaactgctccaaaaaaccttcttttatatcgaaaacggattatccttaacaacaacatcccctacgatccaagagcaaagtgaattattcaaacggatggcacgtgaagacagatttcaccgctacgccctttcagaaggctttttgtcctttttagcaaaaataaatccagaccagaggggtacgcgtatattattcaatcctgatgaacccgaagtctgctatattttatttctcttgccaagaaaagaatatatgtctgatgatggttatcgcaaggtgcggaaggaaatgcttatggactactgttccattgtcaaagcagagtatcctgaagttttgcacattatcggtgtagcacacgagtcttctgaggggcaatatacatctgaagattttatataccttgatgccagagaatggtctaaggaacagcaggcagaagctttaaagctaaaacaagaatatgagatgcatggttgcctggctaagcgaacgatgatatcaaggacattttacccggataacttcaaaatgaaaggccgtgaccggaataaacccagtccatgtgggagtggtaaaaaatttaagaattgttgcggaaaatagtagatgtactattatcgaggccgtctctgactctgtgcaaccttttgacgtagtatgagaagagcgaccagaaagagcggcctctggcaaaaaccggaggccgttcttgtgtcttactttacccagtggacaacggcatcccgcaagaagcgggcgcgcagccgggcacctgtttgtcgtagtaggcggtaaaccgctcgtccatcacatagagctccgcaattccccggtgtctggccgggtcgtactgatttccagtgatggtgagccaccggcggtggagggcggtgatctccttgccctcctcactctccggggacagccccgcccggacagcggcctccagccgctcctggatctcccggcccaggtccgtccactcctggtactgtttctgggtgaggttcctcaccgcggcgttggccccgtccacctcctggtcgccgtacttggcccggatctccgctccgtaaacttcctcgttgtgggctaccacccgctgcttgaacgcctcaaatttctgctcgtcgctcatgatctcgttcctttcttccgctccgatggtgtctttcaccgaccggatgagctgttccagccgctcccgctccgcctccaacgcggccaggtggtttcgcagggcggccagacggtcaaaggagggatcgtccagacattccttgatgcgggccagctccaccccgagggcccggtaatagagaatgtcctgcagccggtccacctccgtcccgctgtagtagcggtagccgctctccgccacccggctgggcttcagcaggccgatctggtcgtaccagcgcagggcgcgggtggtcaccccggacaggcgcgacagctcctgaatggaatactccatagatatccctccttacggatactgtatcagttgacggagcgtcaaagtcaagggaaactttccaatttgacgattctttcccggcagccaatttccatattcccaaacccaaatccgtagtataatgatagcacatacatacccgtacaaggaggcatcgatatgcgcaagaattttggggccaagccctggacctatccccagccggtctttatcctggccacctacaatgaggacggcacccccgacgccatgaatgcggcctggggcggcatcagcgaggacaaggagctgagcatgtgcatcagcgaaggtcataaaactaccgccaatattctggcccgcaaggcctttactgtaagcatggccacggcggaacagatggtagcctgcgactatgtgggcatcgagtccggcaatcaggtggcggacaaggtggcaaaggccggctggcacaccaccaaatcggaatttgtggacgcgcccctcatcgacgagctccccatggcggtggagtgccgcctggtgagctacgacccggagagctgccgtctggtgggtgagatcgtcaatgtgagcgccgacgagtccgtgctggatgaggacgggaagatcgacccggacaagctgcggcccatcaccttcgaccctattcaccacgcataccgggtactgggcgagaaggtgggcaacgccttccaggacggcgccaagctgaaatgatctgctgatctgagacaggaatgagggacggaggcgtggcctccgtccctcattttttctgcctgcggatcactgtcgccccgacttctgccgtttgcggaagtcctcctcaatggcatctttccagtgctcgtccagaggtgcgctgcaccggacggcggccacggcctggcccaccacctcatagttgaggcgggtacccacgctgtcacagtggtagttcaccgcccggtcgggggcgatgcccaggtggcccgccgtctccaccgcgtcgatgttggcccccaggaagaggaattcccagccgtatttctccttctggtgctggatcatctcctttacccgccggaccgagtagcggtggctggcgttctccatgccgtcggtggtgatgacgaaaagggtgtgctccggcacatcctcgctccgggcatacttgtggatgttcccaatgtggtggatggccccgccgatggcgtccagcagggcggtgcagccccggacatagtactccttgttcgtgataggccggacctctcccaccttcacccggtcgtggagcacctcggtctggtcgtcgaagagaacagtggagacaaaggcctcgccgggctccttcttctgcttttcgatcatggcgttgaatccgccgatggtgtccccctccagcccctgcatggagccgctgcggtccaggacgaaaacgagttctgtcaagttcttcttcataagaaatccccctattctgtgttgtttggtttacaaccacagtatagggggaatttgatgcggatgggtcgcctggcgggcgacaaatcgcaatgccgctttatacctcaaacatggtgatctgggtgccgttttcctccaggagccggagcagatcccgggccttgagccatacggtggcggtgttgtcgttggggtggaccccgatcaggccggagccctccagaaaggacttatccaggaagaaggtcaccttgtgttcctggtcgttgagcaaacccaggggcgtcaccgcgccggggatcagccccaggatgtccatcaggtcctggtcggaggcgaaggtcagcggccgggtgccgttttgctgccggaaggccttcaggtcggtccgcttgtcgcccttcaccgtgatgaggtagtaattgcgcttcttgtcgtcccggatgaagaggttcttggcgtcggcttccgggtagggaaggtggatctccgccgcctctgccatgttgaaaacggctttgtgctccgtcacctcataccagatgtttctttcgtccagaagggtgtaaatctcctgcttattcatcgtcaggtatctgctttctcagaattttctccatagccttgcccttggccagctcgtccaccagcttgtccaggtaccggatgtcccgcatgaggggatcctcgatctcctccacccggatgccgcagatcttacctgtgattagagtccggtttgggttcatggcgggggcgttccggaagaagtcgccgtagctcacatcggactgctccagccgcttaagttcctctggcgtatagccggtgagccaggcggtgacctgatccacttcctcccgggtgcgtccctttttctccaccttggccaccagcagaggatagagtttggcaaaggccatttccgtgacatccatgcggggcataccgccacctcctcccgttctggtgccatcataccataaagggggcagtgtggcaatcttatggagttcggtgcgggcatgaatgggaggcggtcattgccagccgtaccaaagggcatggctgtcctaaatgctccaagcgtaaaaaatgacactctattaaaactaatcgtctgtgttaccgtgttgagagcaggggccagtgaggccaccccggcccctaatgtggccagttgcgcaatggggacactcagcgtggttgctttggtcagttccgcacgagcatcagccaggagattaccggtgagttcgaaaagattgttatcaccaactggaatttctccaggagcatcgaaattcatgatttcatccacacagctctcccctttgtttttagcgttgtatcgttatatataaatttctaaggcaggaactttctctcaaactaatgtgcgacatattataccagatgacaggatcgtggacaaccaagatcatccaatcatatactcagaggaggctggatgttttttcgcacattcgttttcgtcctacaaccgtagccgtcaagctcggcgcgagattgatgaaactctcagacctggattcagcggggcaaggagtgagcagatacattgtgccgctcactcctgtcatttaactgatcttcaattttggggtggtacctcacgactccgtctcatagggccaggtgttaataccgccgaactcatagatgttggtgtagcccaaatcagccaacttagaggatgcggtcttactgcggtttccgctccggcagtagaccagcaccgtggagtccttctccgggatcacctcggcggcagtatcttcgtcaatggtgcccaccggcagcagcacggcaccggggatgtggccgctgtcgtactcatcctgctcccgcacgtccaggatgatgacctcctggttgtccatcatctccttggcctcttcctgggtgatctgccggtaggcgccgtcggcggcattcccgccgcatccggccagcaacagtagagagagcaacggggggatcattcgtctcatctgagttcctccagaagtccggcggcaaaggctctgtgcccctgctccgtgaaatgtacgccgtcataggccagggagatgtcccaccttccggcatcggcaaagcggatgacaagccgctccgccagggcttggcagaaccgggcaaaaatgcgggagtcatctatgagctgcggactgggcacccatgttccctgggtcacggacggcggtgcgatcaacaggatcttgcttcggtccagagagattcctgcgaggaaccgctccaatttctcagcggcccgctcaggactacatccctggagcagatcgttggtccccagcatgacgatcagcagatctgtgtcggtaagcaggttaggagcggcgggcgggatctcccggccattctggtgtgcaccccgtcaagtagacagcgaaataatttacattttacgcatgaaaatccttcctgcataccatatggtgctgggtgctatgcagccagtagacggtcatggacttccataggggtccgcacacccaggccgcgctggaggcggtggaagttgtaataggtgatgtactcctggatcatcttgaccaactgctcccggctggtgaaccgcctgccatagtagcgctcccgcttgaggatgccccagaagccctccatggggccgttgtcaatgcactttcccacccgggacatactctgtgtaatgccagctgcagccagcttgtcatggaagatctgagtggtataggcgctgccccggtcgctgtggagcagagggcgggctccgggattgccctccaatgcctgagccagagtgcgatggaccaaggcagcgtcgttggtgtcccggatgacaaaggaaacgatgcgccggtcacacagatccaggatggcgctcaggtagagcttgcgcatgttggtgcccgtatagtagtgaaactccgtcacatcggtgagccacttttcgttggggcggtcggcgtaaaattggcggtccaacacattctccgccagctgtcggggggatgatgccgcccgagtgcagccatgtggggcatgttttaccacagactgaatcccaaggccacggcagatgcgcagtgtccgcttatcgttgaccggcgtatggtaatacttgtccaaatcgtcccgaatgcggcggtatcccttgtctgggctctcccggtggatctcctgcaccaactgggcgatgcgctgattctcggcgacgcggcccccggctgtcccggagcgccactggtaatagctggcccgggagatatgcagtgcacggcaggctggccccacaggaaatccctcgttttccgtaccgtagcgcaccgcttcatactgctgttcctgccgaaactgcctcagcgatcccccctttccagctcttgcactttttttcgcagatacagttccattttcagcaattcattctccttcttcaaccgggcgttctcgatccgcagggcctcatcccggctccggggcgtttggtccgccaggcgcttgccacgccggtcctccaatcccgcgggacccaactcctgatactttttcacccagctccgcagcgtctgtacggctacttggtgtgcctgcgccacctcttggagcgcccggccgccctccagacaggctagcaccgcctccagccgttcctctatggtgtggtcgttcctcatgatagttcctcctctttctctcttggagtttctctcatgatacgcctttacccagtccaataccagattcccggagcgcaaatgatacttttccgcgatggccatggaactgccctgaccggacaggtactcctccgccacttggcgcttgaagtcctcgctgtacttccgtttggagcgattcccattctcctccaatgccgaaattccctccgagcgataccggctgatccaactctccatggtggtgtgccccactccggcccgacgcgccgcttcccgcatacgcagccgtcctgcaagatattcctccaccagcgagactttttcctcaaaagcaacttcttttcgtttgcccatcctgtattcactcccaatgttattttcctgtctgctttattgggagcataccaatttgtcccgaagttaaatcgtatatcttggcgaatagaacactgttgtaaagccaatacaaaacggtatgggaatttcaagagcgagcgcctatgagctggtacacacccccggctttccggcgttccgcaggggcaggcttatcaaggtcagcaagatcgctttctttgaatggatggcaaaaggctccgaaaccgtaccgggaagcgacaaataagcgtgaagtattatcccctgactgcaatactgccgccctttccaaaggggcatacagagggaaaaatccttgaaaatgataccgaaacgctacacaaaaaccccctatctgcgtacatcagatagaaacggagaaaggagccggttatggcaagaatgagcaacaagcggcggctggaatggtctttcttcttaaatgaccgcagccgtatcacttacaacgaactatgccggaaatgccagcacaaatgtaaacagagcttccgggcggttgtggttgactgcccgaagtatctttccaagcgttccaagaaaaaggacaggactgccggaaacggcaaaatcccttaggaactaagggcgcacttctatacatagtctaaagaccatgtatcgtgcgtcctgcggagcttacctctgccgctgataaaatcagcaatccgaggtctgcgttcgcttcgctccgacaaggtggctacacccccttgcgccgctaaagcggctatcccctgtgtacccgccgaaaagagaaatccgctctgcggttttccctttccatcgggttttatagaagcactgacacacggactgtctgcggatggtctttctttatcttataggcaaaggatgtgagaacatggaaaaatctttggaacagttaaagcaggaatataaaaaaaccactgtcctgctggaacgggaaaaacggaaaatgcagcgtttgaaaaaccggcaggcgtatctggaaagcggttcccggaaacagaggacgcaccggctgattacccgtggggcagccattgagagcattgcgccacagacaaaggagctgaccgaaacggaattttattccctcatggaaagcattttgaatctgccgcaggcggagcatttcatccggtctgccgtagaaaaccacgctcgtatttccgggcaggagagaggcggtgactaaggatagcactttatcatttttcaatcgcacagatcaagcgcagcgccggtcagagcgccattgccagcgcagcctaccgagccggggagcgtctttacagcagctactatggagaagtcagcgattacaccaaaaagggcggcgtgatcgcttcggaaatcatgctgccgccccatgcgccggaaatatatcttgaccgggcgactctctggaatgctgtggagagctgcgagaaacatccaaaagcacagcttgcctattcctttgatattgccatgcagaatgaattgacgctggaagaaaacatggaactggcgaggaagtttgtgcaggagcagtttgtggcaaaaggcatgattgccgatcttgcttttcacagcccggagaaagaggacggcggcatccctaacccgcatttccatgtgatgacaaccatgcgccctttgaacccggatggcacatggggacaaaaacagcggcgggaatatcttcttgatgaagatggaaaccgaatccgggataaaaacggcgattatatgtttaacgctgtccatacaacagactggcatgaaccggaaacgctggaacactggcgggagcagtgggcggctgccgttaatacaaaatttgaggaaaaagggctggatgtgcgtatcgaccaccgttcctatgtgcggcagggacttgacctgatacctactgtccacgagggagctaatgtccggcagatggaagtaaagggcattcgcaccgagaaaggggaactgaaccgctggattaaagctaccaaccggctcatgcaggatgtgaggaagaagatcaaagccctgtttgtctggatggcagaggtaaaagaagaactttccaaaccgcagacaccgaaccttgccgacctgctgatcgcttattacaaccagcgcaacgcaggggcatggagcaataaagccagaactggaaacttaaagcagtttgccgaagccgttaattatctgacggaaaataagctgctcacattagaggatttgcaggagcgtctttcctctgtcaacgaagaatttgaagcgttaagcggctccatgaaaaagaaatctgcccggataaaggaattgcaggaattgatacgggagggcgagaattaccagcggctaaaacctgttcatacggaattgaacaatatcaagtttaagaaacagagggagaaatttgaaacatcccacgatgcggagttacggctgttttatgccgcccgccgtattttgaaagaaaaactggacggaaaacccattgccctgaaagcatggaaacaggaatacgcacagttaaaaacagagtatgccgaactgtctccgcagcacaagccactccgggaggaagtcatacggctacggcaggtgcagaacgccgtagataccgcactgcgccggagggagcagccacaggcagtacagagaaagaaacatgagatggagctatgatataaccggcagctttaccgctaccagtatttttatggagggagcatttgaatgtatttgaagcggtgaaacagtctgttaccacccggcaggctgcttcattctatggaatccgggtggggagaaacggcatggtctgctgtccattccacaatgaccgcacgcccagcatgaaagtggacagccgcttttactgcttcggctgcggggcttccggggatgtgatcgactttgccgctttgctgcatggattggggaaacgggaagctgcggtcaggcttgcggaggacttcggcgtttcctatgagaaatccggcaatgcgccgccagataggaagcgtcacaacaggtcacagccccgacaaaaatcagcggagcagagatttcaggaaacggaacggtattgtttccgggtgctatgcgattatctgcgcctgctggagcattggaaaacagcatacgccccacagccgcaggatgccatctggcatcctctttttgtggaagcgttgcagaggataagctacacagaataccttttagatattttgttatacggagaaatagaagaaaaagcggcattgatcgccgcacagggaaaggaggtgctgcggcttgagcagcgaatttcagagcttgccgccggaaacgcaggaagcggtcaaaaggacgatggatacaatggaaccggcgcagacaccggcagaaatccgggagacattagaggggacgcagaaaggcggcgtgaagaacagcatccgaaactgcctgacggtgttccagcgtgacccgctgtttcgtggggcgctgcgcctgaaccttttgacggagcagattgacattgtgaagccgctgggctgggagcgcaccagtaccacgctgaccgacatggacatgaactacctgcttttgtatctggaagaaaattacgggcttaccagcgagaaaaaggtgcagagcgctatcaagattgttgccaatgaaaaccgctaccatccggtcagggattacctgaacagcctgcaatgggacgacacagagcgcatccgttacgccctgcatcactttctgggagccgatacggacgaatacacctatgaagccttgaaactgttcctgatgggagccatccggcgggtattcagaccggggagcaagtttgaggtcatgctctgtctggttggtggtcagggagccgggaaatctacctttttccggctactggcaggcagggacgaatggttttcagacgatttgaagaagctggacgatgaaaatgtgtaccgcaagctgcaaggacattggattatcgagatgtcggagatgatcgccacagccaacgccaagagtattgaggaaatcaagtcattcttaagccgccagaaagaaacctacaaagtgccgtatgagacacatccggcagaccggctgcggcaatgtgtatttggagggacgaccaaccggcaggactttttgccccgtgaccgcactggcaaccggcgctttctccccgtgacggtgtacccggaacgggcggaggttcacatactggacgatgaagcggcggcgagggcgtatatcgaacagatgtgggcggaagccatgacggtttaccgcagtgggaggtataagctgtcgttcagcatagaaatgaaccgatacctgaacgcccaccagcaggacttcatgcaggaggacacacaggctggcatgatctacgcctatttggaggactacaccggcgacagggtatgctccaagcagctttatgaggaagcgctggggaacttaaattccccggcggactgggagacacgggcaatctgtgagattatgaataccggcattgcgggcggcatcatacagggctgggcagcctacaaaagcccgaagcggtataagaaatacggttctcaaaaaggctgggagcgtgtcaaccaagctccgccggagggggacggttttcaggaaatcacggaagaagaagccaggcaaatggaactgccattctaaaaagccgccggttaacagtttggttgacgcttcggttgacagccggttgacggggaaaagcctgatatttggggcatttctctcctttgtcaaccatgtcaaccaagaaatcaaagaaaaagtaaaaagtaataatagagcgcctatggattgttttcaaagtcttttctgccggttgacacggtttggttgacatggagacagcctgcggctgtacacctgcctgacattcccttgtcgggcatatttcatttatggaggtaactgcctatggcaaaaaacaaaaacgagagcaataacaaaaacagcggcaccctgcttaccgaaaaagacggcacccagtattttgtcatggggaaagtccgtatcaaggtatcggagcatttcgcacaggatgggaagccgcttgacagcctgctggaagatgtgatccagcacgctgccgccgcttcctgaaaaatacggaataacgactgtcaatcagcccacgcttatgatatacttgtaccagcgagtattgtataagcgtgggttgtttcttttagaaggaggatttttaaccgtgaaacaaccatacaatacaacgatttataacactgcactatatttgagattgagccgtgacgatgaattgcagggggaaagcggcagtatccagacccagcgcatgatgcttaggcagtatgccgcagagcatgggctgaccgttgtagacgagtacattgacgacggatggagcgggacgaatttcgagcgtccaagtttccaaaggatgattgatgacatcgaggacgggaaaatcaactgcgttgtcacaaaggacttatcccgtctgggaagaaactatatcctgaccggtcagtacacggaaatctatttccccagcaagggagtacgctacattgccatcaatgacaatgtggacaccatcaacggagaaagcgagcttgccccgttcttaaacatcctgaatgaaatgcacgcccgacagaccagcaaaaaggtcaaggctgccatgcacacaagatttgccaatggcgcacactatggagcctatgcaccgctgggctatgtaaaagacccggacaaaaaaggtcatcttctgatcgacccggaaacacgctggattgtagagaagatttttgaccttgccgtacacgggaggggtgccgccagcattacacggattctggtggaagaaaaagtacctacccccggctggctgaactatgaaagatatgggactttcgctaatatctacgccggtgcgcccgcagaaaaagcctatgcgtggacgatagcacaggtcaagagcattttgaaagaggaaacctacatcggtcacagtgttcacaacaagcagagcaacatttcattcaagaacaagaaaaaggtgcggaagccgcaggaagaatggtatcgtgtggaaaatacccacgaagccatcatttccgaagaagtgttccaaaaagttcaagagctgattgcaagcagacgcaggaaacgcagaaacggtacgacacagattttcgcaggattgataaaatgtgcagactgcggatggtctttagcctatggggaaaacaagcagaataagaacccatacgggtactaccattgcagcaagaacggacagggattacgccagtgttccatgcactatatccgctatgatgtactgtatgcctatgtgcttgcaagactgcaatactggtctatgctggcacagaaagacgaggacaagctgctgaaacggctgctcaatgccagcgacagagaaagaaactctgcgaagaaaaagcaggctgcggagctgaaaaaggcagagaagcgtaaagccgaggttgacgggctgtttgctaaaatgtatgaggactggtctgccggacgcataaccgagtataatttcaatatgctgtccgagaagtaccagaacgagcaaaaggagcttgaaacaaaaataagacagcttcacgaaatgatggaagccgccgtacagaccgcagcggatgctgaaaagtggattgccctgatgaaacagtatgtcaaccctgtggagctgaccgccgaacttctgaacactctaattgaaaaaataaccgtccacgaagctgtcaagggcgaggacggaagccgtgagcaggaagtagaaatctactaccgcttcatcggcaaaatcgactgacctttcttttttacccaataatatctttaattaagggaaacgggcctgtccgtcccggactccgatctgctgatcgccctgtcggaggccctggagacgcctgtgagcacgctgctgggcgagacggtggcggagtcggaggcggacgaggtcaaagccctttcggaaaagctggagatcatcaatttgcagtttgcccggagaaaggccgtgcggcgggcggacctccactggctgctcatcgcggtgtgcgggggcatcctggccgtcgccgcggttctggccgcggtaaacagtccctatctgggctgggattacagcgccccggaaaccgccgttatgggggtggccatccacgcctttgaatggggctttgtccgtctggcgccctttgctctgatcgcggcaatggtcggcgttttcctgacgcgaaaaaaacataaggtatgaattgggagagtgcaccactgaacatggagataactaccaccggacaaatataggcacggaaagtcgggcagagtcacttacattctgctatgctgaatccagaaggacggtgtgaccaatggattgggtagcaagtattcatcaggcgatccagtatatcgaagaacatctccgggaggagctgaccatccgggagatcgcgcagcaggcggccctatcccctttttactttcagaagggttttgccatgctgtgcggtataacggcgggcgactacatccgtcagcgccggctctccgccgccgggctggaggttctcacgacggaccggaagatcatcgacatcgcgctggagttcggctacgattcgccggacagcttcaccaaggcttttgtccgattccacggcctcacacctgccgcactgcgaaaaagcggaggcgcggtccgctcctttgctccgcttcggattaaattgacattggaaggtggtcaaaacatggattgcaagattatgaaaaaagaggcgttcacggtgctctgccgggcaaagacgttcaagtatgaggacgccgctgctcaggttccccagttctgggcagagcatttcggcacaggcggcggcaaggtggtttgcggcatgtacggtatcaacctggacgagagcatgggcggcaacgagtttgaatatcttatcgccgacaactacgatccggccaaggagatccccgatggcttcaccacccgcaccatcccggcccatacctgggcggtgttcccctgtactggccggatgccccaagccctccagggactgaaccagcagatcttctcccagtggctgcccacgaaccccgactacaagatcgccgcaggcatcaatgtggagctgtatagcgacgccagcaggtttgaggacggcacccaggaccaggactactactgcgaggtctgggtcccggtggaaaagaagtaaggcacattcctcggcaaaattaacggtcctaccatattgtttcaaacagaatccaccaaacataccagtatcgtatgctgacagcgtgcgctgtatgttatgtgttgcatcaggtgggatgccgaagatattggaggaaaatgtaaacaaatccgtcgaagacagtttcgtttatagataaaaatcgattccgcctgtgaaggaaactacatccggcaatcgatgcggctctttctttgcggcctttatacgccctgcgtcagcctgtccaacggacagcgtatcgcagggcgtttttctatcgtttgaaaggtgccaaggcgcatgagcttgaaatacacttgccccatttgcggcacgcccctgggttataagggcctgtgctgaaaatgcaggtctgagcaggagcgaaggactgattgtcctggacaccggaacaaatctcagagaaacagaaaagccttattcagaacatccagcggctgggtgatgtggaggccctggaactcaccgacttccggcagcaggacgggctgatccatcctctggtgtccacatagattccagcgaagcatcaaacctgatgtgcggcctggccatacagggggatgaccgggccacggaaacgttatcggaactggatttgtgatccccatgcggaccgacacagcagagtcggagccagatggtggggggtggatatcggatacggcggggaacctctgctcatccccatcaacatgcgggacgggagccttctctgcgtgggcaggggcaatgaggagtgagaaattccgccgaaaaccgtaggcggactgcggcaggaactggtgaagctcaaccaactggcatggcaggccggcaaggacacaatcccccgctggacagaaacagagggttatccggttgatggtagcctccaccgctgtattcaatacaagaatattggtttggaatgcaatattatcaatcgtcctgataatgttctcaatttcatcggagccctgtttgaactcttccatagaaccggcctgttcggccgctccccgaaccaacgctgcgctccgctgaaaacctgatcgccggttttatcatttgggttgctttgaatgtcagcatccagatttccctgggcaaattcctgtgcaatcaaaatgggtatccatactgccaatttgtcaaatccggttctgtaccccctagggcttgtttgaaaattggcgatgtgcccggcgacgaggaatttggggccgctggcaagcaattttttcgcaggaatcctgacggatttcagggaaaaattgcgccgtccagcggtcaaaaggcccgtcgattgggcatgttgacatttttcaaacaagccctaggatacaaaaatccaagcatgtccacagtcagcctgcaatgaaacaaacaagtccaaatatcttataggaagccgtgggacttcgcccacggctttttagctggaacaggtacttgcaaccctgccttttcttatggtgcactattccaagatcatttctatcagcaaggaggtgctgccttgaacgggcaggtttacggctatatccgggtcagcagcagggaacagaacgaggagcgacagctcatttccctgcgggaagtacaggtgccggaggagaacacatttatagataagcagtccggcaaggattttgagcggccgcagtacaagaggcttctgcggaaattgaaaaaagacgatctgctctacattaagagcattgaccgcctgggccgcaattatggcgagattttagagcaatggagaatattgaccaaagaaaaaagcgttgacattgtggtactggacatgcctctgctggatacccgacaggggaaggatctgatgggcacgtttttgagcgatattgtgctgcaagtactctcctttgtcgccgaaaatgaacgtgccaatatccgtcagcgtcaagcggagggaattgcggctgccaaggcccgaggggtacggttcggccggccgccaaagccgctgcccgataactacctgagcacctatctgcaatggaaaagcggggcactcacagggaccgccgccgcgaaggagtgcggaatgccgttggctaccttccgttaccgggcggaacggtacgaaaacacgaaacgttgaacagcaggcagcttcacaaaaaggtgtacctttctgtgaagctgcctgctgtctctatacattatccttatcgtccaaatcctcgtcatgttaagagttttttgaaaaagattttgaaaattgggggcttacagaaaggtacacatttctgtaagcagccaaaagcaaagcatggatttggaggcgggcggccacgatggcatccagagaaaaacaatataatgtcctcaagctgcgcctgtatccaacctcagagcaagcagaactttttgaaaagacctttggctgctgccgctatctctggaaccagatgctggctgaccagcagcggttttatttggagactggcgtccacttcatccctaccccggcaaaatacaaaaagggagccccttttctaaaagaagtggataatcaggcactcattcaggagcacaaccagttgtcccgggcgttccgtttattttttcaaaacccggaggcttttgggcatcccaattttaagcgaaaaaaagatgaccgggactccttcaccgcctgcaatcatgtgtttacttccggcccgaccatttataccacgcgggacggcatccgcatgaccaaggccggaatgattcgggctgtctttccacgccgcccgcaaaacgggtggaagctcaagcgcgtcacagtggaaaaggcccggacgggccgctattacgcttatgtcctgtatgaaagcctggtacagccgccggagccggtccttcccgctccggagcgcaccctagggctgaaatattccctgcgccacttttatgtggacgaccagggcaacagggccgatccaccccgctggctgaaacagtcccaggaaaagctggtgcatcttcagcggcggctgaaccgaatgcagcctggctcaaaaaattatgaggaagccgtactgaaataccgcctgctccatgagcacatcgccaatcagcgcagagacttcctccacaaggaatcccgacggatagccaacgcctgggatgccgtatgtgtgaggggcgacgatctgggtgcgatgacggacacgctgattcaggccgggagcgccgcaaaggaggcggggttcgggatgttccgggaaatgctgtgctacaagctggcccgccagggaaaggcatttattcaggtagaccggtatctccctaccacccggagctgttcggcctgtgggttgacgcgggacgcgctccatgcgcgggattacaggcgaagtggttgggtctgtccagagtgcggcgcggttcatgaccgtgaggtcaacgcggcaaaaaacatcaaagcccgtgggctggaacagttttttgatttacaggggcagaacaggagcgcctgaccctttccaggcgtcctgtgctccgccttgacaatatgccggccgggacaccggtgaacgcccatgattccggctggagagcgtggatggaacgccggtggggagcctccgcccttccatccacattctccggaccgccgagtgggaaacgagaggccgcatccgtgcggctgaagcctgtaagcaggcgtccacaatattatgacgatgtttctgcacgcggcgcatggatgcgcgccgctggccacaggaaggagatcccccatgcttcagctctctctgcgccccggtgagtatctcaccatccatggcgacattgtggtacagctcgctcagctctccggcagccgcgccttccttcgggtagaggccgaccgcagcatccccattgtgcggggaaaggtactggagcggtcgggggctccccggccggagtgcctggcatctcttccccgcagccacgccaggaaaggccgggatgccgtctaccactggagtgcggagcgggagcgggccgtccgcacaatggaacagctcctggagcggatggaggccggggacagccgtgaggaagcccaggcgctgcgggcacagttggagcacctgcttccaactgtatgggaggaggagctgtccggccaaatacaggccctgttccgcagcaaaacagcccaggacgtataaagaaccaccttagtttggtttcacccggtctcgcgaaccggttgaaataaatcgaagtgcagggacacagcccgccaaaggccacggcgtctgtgttggtctgccaaaccactaaacgcacatgagggatcggtgcgttggaccagcaaacccaatatcatttcagaaagaaaggaaacgatcgaaatgaggatccagcataacatcatggcgatgaacgcctaccgcaactacaccaacaacacctccgccctgtccaagaacctggagaagctgtcctccggctacaagatcaaccgcgccggtgacgacgccgcgggcctcgccatctctgagaagatgcgcgcccagatcaccggcctggacaaggcccaggacaacgccaaggacggcatctccctggtgcagaccgccgagggcgctctgaccgaagtccacgacatgctcaaccgtatgtacgagcttgccgagcagtccgccaacggcaccttcgaggatgagaccgaccgtgtccagctccagaaggaggtctcccagctcaaggacgagattaaccgcattgccgactccgccaacttcaacggcatcaagctgctggacggctctatggccgcggcggatggagcagagacagtcagtaccattacagccggtgccgcggctactgctgttactgccagcggcggcgcaaaattttcccaggagcttaccattgcacatggcacacaaaacaaggagcaggagctgtccttcaaatacattgatgacagcggtaatttgcagacgggcaccatcaaattccaggctggcgcagctatcgatgatgacgtggatgccgctgtcaccgagcttcaaaaggttttaggggacaagttcacggtaagcaacaataccagtaaaatcaagatcgaagccaaggagaacggcgcaaccgagctgcagttcctgtccatcgagcagaaggatgacggaactgtaaaaaccggcacatcggtcggagcggtgaccgctggtaaggacgatgtgttcacgattgctggtgcaacggtggctgctgatgtgtcgaaggacaatttctttgtcatcgacggccagaaatatcagatcgtcacccgcggcggcaaagttgccagcgacgccaaggcgctctacatcgaccagagcagcggagccttgactgcggattcggccgctcagattgtggagcagttgaaggattacggcgtaaacgcctctgtcaacgccaccactaagacgagcatcaatatcgccaaggcaagcgacgattccaatgcctccggcggcctgaccctgcagatcggtgataccagcgactcttggaaccagctcaccgtttccatcgacgactgccacaccacggccatcggcgttgacggcgttgacattggcacccaggctggcgcaaatgccgctctggataccatcaagaaggccatcaactatgtgtccaacgtccgcggtaccctgggcgccacccagaaccgcctggaccacaccatcaacaacctgtctgtgatgcaggagaacatccaggacgccgagtccaccatccgcgacaccgacgtggccgacgagatgatggcctacaccaagaacaacatcctggtgcagtccgctcaggccatgctggcccaggccaaccaggtgccccagggcgtcctccagctcctccagtaagagatcgaaacggtatcacagccacaacaccgcgggggccgggctcagtgcccggcccccgcttttgtctggaatgaggtaacattgtatggatacgatcgaaatcgcccgcaggctggcggagctgggacagaccggggaggcccaggcggcctatactctggcactccaggaggcggcggagcggaacccggagctggagctggaggcggccagctatctctttttttctcgggggagctatcaggtggcctatacctcctttgtctccctctataaccgtggtctctaccgggcagagctgctggatttgatgacccaggccttctacctgcccaatgtagaaaaacagcggcgtcaatatgagcgcaactgcgccgccctggccaaatatccctatctctttcggaaggactttcccccctttgaggacctgcccatccaattcttccccttcaacgacgaggggtatgtcccctttctcaaagcggaagaccgattcgataagtatgtcaatttcaatgatccagtaatcgaccggtactttttccgggatctagagcagcccgttctggcggtggacgtatactcccagtaccatctggagtacctgaacgacaacgtccgcaagagcgagtgggtgggccgggaaaaccacatctacctccactacacggattggatgacattctgcgcctacttgcaatgcttggaactgcgccccctcctccctggaaaaaagctggtcttcttaattgagggagaggtggggcaataccctatcgactttcaggcccgtttcggtatcgactacagccaataccccgtcaagccggtgagcatccgggaggtcacccggctgatctggcacacccagttggccactcacaacggcggcgacttctttaacgagatcttctatggacaccccaatctcctggcctatgaatccgtcattctagacgatcttcgcaagcgactgacagagcttaaagctgagggccatcagagggcggactggctggccccccggctccggcagcagttagaccgtatcaagcggcccacagagaaggatctgctggtggctctctttttgaacaatccctatatcagcggaggcttggatcctacatcccggatcgcccccgccctcttcttccagccccacttctacaacatcctttacgagatccgggagtcggaggacagatccaccccggtcctctattcagaggaatatgagcagatccgcacttcaccactgttccttggcttcccctacatcaagaccttcacccccatgcgccgcccgaccaccagctatgcggccagcgtgcgctttgcgaatgacaagcggtttcagggtggtaagacgaccgttttcacagatattatggcccagcggctcctcaaccgcagctacctcatcgacccttgggatcggctgtaccgggatagcgtgctggtgcgctttgaggacggcaagctcaaccccagggctacctttactgctctagcggaatttctggatcttccctataccgagagcatgacctactgctccagccggaagggtattgaccctgagtccctggagggtaacgcaaggggcttcgacccagccacggtataccgaacctacgatgaatttgcgaatgacgaggaaagggcctttttggaatactttctgcgggacacctatgaatactacggctacgacttccactattatcggggagagctggtggacgaggcctggattgatgagaagctgggggcctttacctgtctggacggctacatcgaacactcttacaaagagacgttacgcgtcacggcaacgaaaatcacatgcaacgctgacattattgatgtgcaggtggatagtccagttcctagctatacgaaaaaccgccgccgcatcgtggactttctcctccggggcctacattttacaaacccccaaggccagcctttaaaaatgatgaagcctttaaagctggacccggcgctgctggaacagccgctgtatcactgaggaggaggacatggaacacaagggaaccgtatactttttcaccggcctgtctggggcggggaagacgaccgtgggcagcctgttctaccagcggctcaaaaacaccaagcccaatgcggtctatctggatggggacgaaatccgggtggccttcggcgaggatgtgggctacaccagcgatgagcgcctgcgctgggcgggccggatcttccgggtgtgcaggctgctctccgaccagggcatcgacgtggtgtgctgctccatcgccatgtttgacactgtgcgccgctggaaccgggagcatattccaaattacaaggaaatctatatccgggtcaaaaaagagaccctcatccagcgcaaccagaagggcctctataccggggggcgcaatgtggtgggggtggatctgccctttgacgagccccaaagccccgaccttgtgctccagaatgacggggagcgcactccgctggagctggtagaggagatcgagggggcgctctacccgaacatcgtggagcaccccatcgacaataccgattactggaacctgtattatcaaaacaagctctgccccaccagcccctcccccttcgcccggtatgtgtccaccctggtggagccggggcggacgctggcggagctggggtgcggcaacgggcgggacgccctctactttgcctctctggggctggacgtggtggcgatggacctctctgaggcggccatcggcatgctccggcagcagccggtcccacacgcccggttcgtatgcggcgacttcgtcagccacaccctccaccagccggagagctatgactacgcctacagccgctttaccatccacgccatcaaccagaagcaggagcggatgctcctggggagcatggcccgggccctcaagccgggcggaaagttcttcatcgaggtgcgcagcgtccatgacccgctgtacggcaagggggaggcgctggagcgcaacgcctttttctacgacaaccactaccgccgttttcttgtgctggacgagctgaccgaggccctccggcaggccggcttccgcatcgagtacgccagggaacagaccggcttcgccccctacggcaacgacgatccccccgtcatccgcgttgtggcggtgaagaattgaggaggcggtttttatgacctgtccggcggatctgcatacccataccaccgcgtcagacgggcagtataccccgtcccaactggccgccaaggccctggcggccggaattcagattctggcagtcaccgatcacgacaccatggacggcgcggaggaggccgtccgggcgggacaagcctgcggattgacggtgctccgcggggtggagctgggagcccgggaggaccgtcacatgcacatactcggcctcaatctgggccccgagtgtcccgccctggcggagctctgccgcaggctccgcgccagccgggaggagcggaaataccgcatcgccgcgtttctccgcgggaaggggctggacgtgccgctggaggaggtggaggccctcgccggcggcggagtggtcgcccgcccccacttcgcccgggtgatgctccggcgcgggtatgtctcctccctccgggaggccttcgaccgctatctggacacggacgaataccagcgcattgagcggtggaaggccggcgccccggaatgcatcgcggccatccatgacgcgggcggaaaggcggttctggcccatccctgccagctcggctgctcccacgggcgcctggaggaaatcctccgtgcactgaaggacgcggggctggatgggattgagtgcttttatccccggcattcccccgaacagaccgccgcctatctgcgtcttgcagacaaatacggcctccatatcacggggggcagcgatttccacggggaggccgtccgacctgataccttccttacccccattcccctcaacctcaactggctgggaaccttccaaaatgcccagctagtccccaattgatttacgtacggtgtcacaaatggcatttggcatggtatgagggatttctcgattagataagggtagatcagaacaggtatgtatccggggctttcttcatctgaaatagcataacagagcagtatgtcggcttcggttatcaggcgacagaactggaactgcccttccgaaccgccagcccgaaagggcggcgtacggaagtgcagttctcttttttacaccaagcgcagaagctgcggcctatgtgttttctcctgtcagagaaaaatatctatcttcctatatagttcagcccggcaggtaaacagatgccctaattcaccccgaccaatcaccctgctctactgcgctttcgccgcaccgaaatagttcccgcagcttggtctaccttatccgcctgttctatctctcccaacgtctttcgcaacagaaaccctaccggaagtaatagcagattcaaaaagatggcatatccgagagacaggcatgctacatttagggcaatccctaattcctccagattaccgccacccaggctgtgcatcattttaatcagactaagcagtgagccagcacctccggccagtaaagatcctatagccacctgccgataggccagataactctccagcgcacgggcggcagaaggttttttctcttgaaacatagcccggattgcccaaccaaaagcgcggaaagagttgttccccagaagaaccagtacgcacgcgattagcaggaacgccagcgttgtataatccagaagcgacagcaagtttgcaacatccagtctgattccggccggtgtaactgaacagactgccccacctccgaccaacagagcgcatccaaagagataaaccagatatcgcacctataccacgccctttctctgtctacagtagtatttcagtttccctctgctcttaatggtttcatgtatcatatcgacatatttttgcaaaaattaaggctctaacctggctacatctcctcactgctgacagtgtactggctaaggtgaggtacaggaacgcgccgtactcaaaaatgcggctaaaataaacgaatatgaaaaatgtccggtgggtctcccatcggacatttttggccgtgtctactgcggatacccgtaccccggtcaggatatctccatcatcttcccattttccagcacaataggcggcagctccgtctcgtctccatataggtccggacgggccagaagatagtgctccaatgcgttccggctctcaaatttggtcgcctggaagggaccagccgggccatacttctccacaaacagcagtccgtcctccgtctccatcaatacgccggtatgtcctacaaagcggaccccgtcaagtggggaatgcagatatacctcgatcagggacattcccttggcgctgtccacctgtatgccacgctccgaccacgcttcctcaatgcgggcaaggtgttcctcctgggtcgccgccccctccagaggtacggcattgaacagagtaatgaaatcggcccgtgcttctgaactgagctggtattccttctgcgtgtcaatggcctcaatgtcaaacattagataggtatcactctcatccgcagtcccacaggtctggagctgatcccgcatcaacaggaacgcggtcaggcggcaattggcctccataaaaaatgtgccgtctggcagttccttaatgtcaaacaaaagtgagctgtagtcaacaaagtcaccctccatggcggtaaagccctccgtgagggtgggcgtggtcacccgggcgttaaagccgtctgcccaggccagcagggtatcggtctgctcctgagatacgccgtgggcctgaagcgcatccacgacctccctcctggagctgtcatccgtcaaattggaatagagggcctgtgttttttccggcacatgggaaccgtcaggcgcggagggtaagctcccagcaggtgtactacagctagccagagaaattaccaagagtgctgccacaattgtagcgaatcgttttttcttcatatcaatctgagttcctttcataattgcctgtgaatttgagatgtatctaacagagcatatatgttccggagcaaatctgtcagctatcgtccagcacagatttgcggcgtctccacattatagacgcaaatccagctaaaaagttttcagcagctgctttgtttctaatattcgcgctctatcgcgcccacaaggaatgtggtataatatttaataactttctcaaaaaatgtggagggaaatgtgacctggcggccaggccatgcgtgtatagaacaggaggtaagaacattgcgtcatggagaaacggttgatttaacggcgctatacgaaacatattccgatctgctgttccggacagcactgacctatgtgagccattcagaagacgctcaggatgtcgtccacgatgtgtttgcggtctatctggcgaagcggcctacgttccaggatacgtcccaccaacgggcatggatgctgcgcgttacaatcaataaatgccgggatctccagcgccgcaacgcggtacgcaggtacacccctttagaagatgcggaacacatcgcctcgccggaggattcagaaacatccgaacttctggccgccgttcggagcctgccggacaagctgcatgaggtggtggtgctccactatctggaagggttttcagtggaagaaaccgcacgctgcctgcgcatctcggtttccgcagtcaaaatgcgtctgacccgcggccggcaggcaatcaaagcactccttggaacggaggaatgaatatgtttgatcaaaaagatgtagaggcataccgcaggatcaaagcgccggaggagctccgggagcaggtcatgcgcctggaacaaaagccggagccgacacgcaccagaacgaaatggatttcgtttggatctctggccgctgccgcctgcgcagccgtcctgtttattgccgctctccctccctttgctgtgcgtggggaaaccgccctcttgtatcagggcgtacccattggggcggaaccggtctccattccggcggaccatcctcaaatgacatccggacttcgggaagtctccggcggaattcctctggcgctggaaatcggcgaaacgacccgggtatctgtttccggcggtgaattcagcctgtttgatccggagggcgaactcctcggagacggcaccgaagcagagatctccgaagacgtcctgctctactgggacctctccggcacagaggacaccatgttttccctgaccttgaaaaccaatggcaaacagcttacctatgtactctccatgcgtgacgatggagggtatgaccttcagcaaaatcagtcacccaaataaatgcagaacaggagaccatgtattatgaaaaagatgatcacttttattctcggtgcggcaatggcgatctccctggtgggatgcagcggcaacaatggcagcagcaatcacggcggaagcggagacggctccacctcttcctactccagtgcggtggaggttctggagacggtctatggggtgtattcagaggatcaaaagttccccatcggcggcggcgattcggagcacatgaccacagatgccccaggcgcctttgacgtatccaagaccgaggagctgacctccaccttgagccttccggagagcgagaccacccacattgatgacgcggcatctatgatccacatgatgaatgccaacacctttaccggcgcggcctatcacctgaccggcgatgtgagtgccgacgagttcgccgacgccctcaaggagggaatcctggcgaagcagtggatctgcggtatgccggataccttagtcgtaatcaacgtggacggccagtatgtcattgccgcgtatggcgcggatgatttggtggaaaccttcaaggataacgcgctctctgccctggacggagccgaggcaatcattgacaccccggtggtagagggctgagaaccgccagttcaatataacattatatagcgttgcggggcggcctcttcgccagggagccgccccgtacgttgctgttaaggaaggttttctatgcttttttccagcatcccatttctatactactttctcccgctggttctggccgtatactttctcactccggcccgcttccgaaatgcagtgctcctgctggccagcctgatcttctatgcctggggcgagcctaaatacgtccttcttatgctggcctccatcctgtccggctatggcttcggcctcttgcaggagcggtaccggggccaaaaaggggccaaactgttctgcgggctctccgtggcggtcagcctgtcctttctcctgtacttcaaatacgcagacttcttcctggaaaactttaacgcggccaccggactgggggttcccctgctgcacatcgccctgcccattggcatcagcttctacaccttccagatcatcagctatacggtggatgtataccggggcgagccagctcagaaaaatctgatccacctggcagcctatgtggctatgtttccccaactcattgcagggcctatcgtccgctattccgacattgcacagcagttggaacaccgttcccactccaccgctctggctgccgagggggtgcggcgctttctcattggattggggaaaaagatcctgatcgccaaccaactgggagagctgtgcagcgtgttccgggcgtccgatgagaagtccgtgctcttttactggctatacgccgtcgcattcgccctgcacatttatttcgacttctccggatacagcgatatggccatcggcctaggcaaagtatttggctttcacttccttgaaaactttaactatccctatatttccgccagcatcacagagttctggcgccgctggcacatgtcgctgggtacctggttccgggattatgtgtatatcccgctgggcggcaaccgcgtcggaagggcccgccaactgctgaatattctggtggtgtggatgctgaccggcttctggcacggggcagcctggaacttcgttgtctggggactgatgttcgccgttcttctgatcatggagaagctgtggctgctgaaacctctctcgaaatgccgcccgctcgcccatctctatgtagtattcttcgtcgtgatcagctttgtgatcttcaacgcggagaatatggggcaggccctctccgacattggcggtctgttcggtgccggcggtatcccgctggtttctgcagaggcggtctactgtctgcgcagcttcgctctggtgctgattctggccgttttgggagccacccccctcctccggaatgggcttgtccgcctctcccagtaccccaccgccggtaaggtcctcaacgcactggaaccctttacactgtttgtactgctgctggtcatgaccggctatctggtggacggctcctttaacccattcctatacttccggttttgataggaggataccatggatagcaaaaagaaaaacctgacggtctgtatcctgtttgggctgcttctggccgtggcctttctggcctgtttgtttctccccaaggaagccacttcggacagtgagcggaggaaactggccgccatgccggcgttcaccttggataccgtactgagcgggcggttcatgtccggctttgaaacctacacccaggatcattttcccttccgggaccagttccgtacactgaaagccctgtccgccaccggcctgttccaccggcaggacaacaatgggatctatgtttccgacggcttcgccgccgcggtggaataccccctgaacgagtcctccctggaccgggcggcaggccgcttccagtacctctatgacaaatacctgaacggcagcaatcgggtgttcctctccgtaatcccggacaagaactgctttctggcccgggagagcgggcacctctccatggattatgcgcaattggagtccctgatggcacagaaggttggctttgccgactatatctccatctcagacctgttggagcgggacgactattacaggaccgacacccattggcggcaggagcggatcaccgatgtggcggagcggctggcccaggccatgggggtcaccttgactcaaaattacgaagagtccgtgttggagcgggacttctacggcgtttactgcggacaatcggccctccccttggcccccgagtccatccactatctcatcaacgatgccatccgggactgcacggtgtatgattaccagaacaaccgaaccggaacggtgtacgacatggagcgtgccatgggaaaggacccctatgaaatcttcctctccggttctctgtctctgattaccatggaaaatccttacgcccaaagcggccgggagttggtgttgttccgcgactcttttggctccagcattgcgcctttgctgctcagcggatactccaggatcactctggtggatattcgctacatccagccggactacctcgggcagttcattgattttgaaaactgcgatgtactgtttctctacagctccctggttctgaacaacagcgacacgctgaaataaccgatccggctgtggatgctttgggttatccacagccggatctttttgttcaaaggccaatctgccaatccatgctgtcattggaacagcatccccattcccaccctcgcagacgcagtcaatacccggtcattacaatcatccgttacaatacatctgtacgcagtcggggcataacaattcttgaggactcgaacctcgcacgtgcccttccgtgtatccatgatgcgacttacgctgtcgccgcgcggcattcgccctgcttctgctaccaggcactttggcctattccactaagtcggtcttccagttgctctcttgcagccggttatccagccggcgcagttctttggacatccggtcgatctccttttgccagtccgccacagagaacgcagaccggatcttgatctccgtatttctggcgcggtaggatatctgacttcccgcgtacacaacatcccggtatacatggagtttgagggacagggcatccttttgggcaatcagttctgtcagagtctgcccctcaaccacagtctggcagttggtccgattgattctcgcaatcaaataggacaggcgagaaatggaagcatccagctcctgttttagattctccgggcattccaccggttgctcgccctcctgcaccagcgcattgctgctcaaacggtttttgagctgttcaatattccggttcagatctgcgcgttcctgtaaagcctctgcaagtttcataacttcacccttcccgatccatcggctgctctatagccctggctttcttaggagatgtagataccgcctgtttcaaaggcatcttacagcgtctgcatctctccttatccgattgaatactgaaacatacatacagagcgtgaatcccataaacgctatgtataaaagcaattataaattatagtatagcatactttatcagaaatggaaccatcgtctgcccgaaaatattctttttgcagcagcggttttagcgataaaaatattgtgtgggtaccaaaccggccagcaaggaactgtggaccgctgttcttcgcctccgctccgttggggacagatagtaaccccacacaccttgaatttcatcaaattgtatgatattatttgcaacaatgttatcgcggaacggccagtgctcaactttcttttccctttcctgcccgcattttttctattttcagcagccgcaatttttcacatcatccacggcgatatgatactccctatcttgtccccggcatgcgccggactagagcaatgggtgccccgagcaggcgggaatccctggggcgtcaatatgaaagcaggtcagataaatgaaacggtttgtgaagaatgtcgctctggtgctccttgtgtggcttttattcatcattctctgtctagtcattccaccggcgtttcacaaaagggccactcccgaagattggctgaacgatatccgctatgaacataccgcaccagagcgggtgcggagcatcgacgacaactctgatgccctgctgtggcggctccggcttattgaggaagcaaaggagcggattatactcaccacgtttgatttttgggatgaggaaagcggccaggatgtgattggcgcactttgggcggcagccgagcgcggtgtcagggttcaggtgcttctggacggcatcaatggcggacatttccttcccatgagtaggaacctttgccagttgtcaagccatgagaacgtggagatccggctctacaacccgatcaaccttctaaccccgtggaaaatcaactatcggatgcacgataagtatctgatcgctgatgactttgcctatatcctgggtggtagaaatacagataaccgcttcctgggcaattaccaagaacactacaatgtggaccgggatattttagtatatgaaaccgagcctggggcaggccagtcctatcaacagctgatgaattattttgaggcggtgtgggcgcttccatgctgtaaggtttttaaagattcaaggtgtgaaagcgatctggctggctgttatgagcagaccgcccaacgttacccggaagtctttacagacagtttgactacagcagaatgggagtccgccacactggcggcatatagcgtggagctatggtccaatccaatcgagccggaaaataagacaccaatcctgtgggcccgcatggtagacgctatggcgcaggacagtaacgttctggttcagacgccctacattatatgcagtaaggatatgtacgaggaccttcggactgtctgtgctgcgggtaccagaacagatattctgatcaatgccgtagaaagtgggacaaatccttttggctgcaccgactacttaaatcagaaaacgcatctccgcagcaccggcacccatatctatgaatatctgggcgagcaggcacagcatactaaggccgtgctcataggcgaagatctgacgctcgcaggttcctgcaactttgatatgaggagtgtttatctggacaccgagctaatgcttgcgatcaaaagcccggggctaaatgctcagatccgtgctcaactcgatgtactgaaggaaagcagccgacacatgagtcctgatggctctatagaagatggcccaagttatgttcctagaaagctaagttggggaaaagaggccatgtatgctgtcctgcgggtaattactttgccattccggcatttgctataatttatttccaaataggctggactttttgcgcttctgtgtgtggtattccgtctatctattttccgagtgaatgcctgagtcacaccgttgggcccagatccagaggtaacgtgagcggctccgccgccactgacacggtctggattcgaaccaataggccgtgtctatcatactttcgtccacatcgaggtgtggcagaactgctctttgcagggcggctgttcccacctgtctcaaaactggggtatcggctacgaaaatatggctattttggttactataacgtcaacgagaatggttcccgtaaagttctgtgcactgctgatggtatgaatgaggataaagcgagtagcgccagcttctttcagcggcccggtgaccatggcctggaaagtgggcagcttatggttgaagaaaagtgtttgggaattctggagcctgtacgagaagtgtctccggaggcaataccagcactgcactgtttgtattcactgttaccctggattccaaagtaaagctggcagcaaaattcttagaggtccggcactgttttatgtttctatcccgtagcataaattgtaaagctaaaaaagaaatcccttgaaaccatttcgtttcaagggatttctgcaaaggacggtcaaaaccgatatttctataaaattaaaaaacgccgcgaagcggcgataccaaatcacaacccagcgcagcggttgtgatttggaaaggatgagcagcggcgtgagtgcgctctgacttttgtaaaaaagtcggagcaagcgatacaaagcttgctccgacgtggtcggagtgtaattataggacttggaaaaatccagtcatatcaatggttttagcgcagcaagcaagaggcttttatcccattagatacgataattagaaagatcatccagcttttcggcaaatgattttgtctgatcggcttctttttcaaattgcgccttgatttgctcatttacatctggagacataacaggaatcaatttcagatcctcttctttcatgtagaggtctgcaatatcttccttatctccacattgaggaaagaggacgacccaacagccgtcttttggctccttctcccagacaaccccttgcattcccttgtgaacgccttcttttgcatagctatctttttctaccatcacttctacgcaatccatcatcttcattttattttcccccatacggcgtattcaatttgagttttccgttcagcataagcatccatccagtaataaatgacacgctgcctgatttgccttttctgggaatcgtaactctgatatcaattcgctagcctcgtctatccaactttcctaacatatagtcaccggatagatatttttcaagtgcctgtttctcactttgattcttaagccacgtagaatctgaagcagaatagccccaactttcaaatgctcgattttttccatgtctatatgtattttctgggtcaaatagatagggatcaaatttgctgtaatcgctatatgatgttgtattcatcaaaaccacagcatagggaatcgggtctaatgtgcagtggcagtatggatgatgtggacaagacggagcattttcttcctgaaaccaacaaccatccaacattaagcattcctcacagtgggttttgccctctgaatggtgcgtccattggacccagcttggctgctctgccgttttctgcggaagcagctttcccgtatatcgtttgtaatatatcatatttcctcctatcatgtaaaatcaggcttctacatataggctggaaaaagaaaaaagttgtaaatttctgtacaactttcaaaatgaatttacaaattatgaaaaaatgggtgagtcctataaggactcacccatggcggaagcggtgggattcgaacccacgtgcccttgcggacaacttgatttcgagtcgttggaaggcagtgtcctaccgtgaattttgtgttcccttgtgagcgtttcagaacgccgcaactccttgattttactggggctgcggcgtttcttcatgccaattcagatggttgcggatttgccggtccaaagcagattttccggaaaactgtgagcgttgtgttagcgggaaaccgtgttgactatgttcagagctatttttcgccctgtcgaaagcggagcatataggtttgtttttggagaagtttgtgcaatcaatagcataaacttgatttttcaatttctttatgctacactgcaaccagaggtgataggatgctgaaaagtggaagtgagctgcgcctccgtgacctttacctgaaccggctgatcgcgtttcaggataccgagccggtgaagatcatcacaggcatccggcgctgcggaaaatccagcctgatgaagctgatgatccttcatctgcgggatactggtgtggcggatgaccagatcatcgagatgaattttgaatccatggacttccgcagaatgactgtggaggaactgtaccggtatgtgaaggagcggctgccggagaagaagcgcgcttatctgttctttgacgagatccagcgcatcgaccagtggcaggatgcggtgaattccttccgggtggatttcgactgcgacatctatgtgaccggctccaacgcctatctgctgtcctcggagtacgccacctacctggccggacggagcgtggagatcaagatgcttccgttgtccttccgggagtttctggacttccacggctatacggttcgggagagcaaaagccccgccggaggaatacggaagcggatctacgatgccgacggcgagagctatgagccccaggagctgctggacgcctatctgcgcttcggcggaatgcccgggatcgcagatgtgggcctggataccgataaggcgctgaccctgctggacgggatctactccacggtcgtggtacgggacatcctggaacgggagcgccgccgcggtcagcggcagatcaccgacccggatctgctgcggaagatcatcatgttcctgaccgacaatattggcaacagcacctccatcacatccatcagcaatactctcgtgaacgaaaagctgctggaccagaaccgtaagggcaggccctctgtccacaccatccaggcctatgttggcgcgctgctggagtcctatatcttctatgagatcaagcgattcgacatcaaggggaaggagtatctccgcaccctgggcaaatattatatcgtggacattggcctgcgcaactatctgctgggcttccgggacatggacaccggacacatcattgagaacgttgtttacttcgaactgctccgccggggctacgatgtggctatcggaaaagtggacaacagggaagtggactttatcgccgccaatgcggaggagaagcggtacatccaggtgaccgagtccatgaacgaaccggccacccgggagcgggagctggcccctctgcggatgatccgggacaactatgaaaaaatcgtcattgccggaagctgtgactatcccatgacggaggacgggatcaagatcatcaagctgacagattttctcctgaacgcctgataggatagtccaatggctgctcacaataaaatatacggcaaaagccgcggcatcccaaccgggtgccgcggctttgtcatgccgtccgaaaggaggaatgaacacaatggctgtctttcgtgtggagcgtacccgtgacttcaccgtcatgagcaaccaccatctgcgggacaagcggctgaccctgaaggccaaggggctgctgtccatgatgctgtccctgccggaggactggaactacagcaccctgggcctggccgccatctgccgggagggcgtggacgccatccggggtgccctgcgggagctggagaaggagggctacgtgatccgccgtcagctccgggggcccggcgggcagatccaggacatcgagtatctgatctatgagcagccgcctggtacgggttcaccaggtacgggaaatccaggtacggtgagaccatgtccggagaagtcggcagaatctaatatggatcgatcaagtacagagtgatccataatcaaacgatctaggacggaggtttacagacttcaaagtcagggaagagaagaagtagccccggcgagcagtgtctccgccatgatgctccctgttccttcctctgtttttgatcttaacaccggcacctgtgtagccggtagaagggaacctgaacggacaatgcggagggccgtcacgcgggtgacggtcttttgggcagcttcgtattgtccccgtctccagccccacgtcccccgcagccagcccgcaggcgggtttttgccgccggggcgggtacctgccccacccccggtccaccggcggcaaaaacggcggcaaagggccgaacacggcggggcctgccagggcccgctgtattcgagtccgaagccgcaaaatggggtcccggggtgtccccgggcgcacgccttgccgccttctgggcggcaaggtatagtgcgttataccgccctgacaaccgcacgcgaaaatgcccggccctccttgcaggggccgggcatttctcgtgggcggggaaaccgccgccgcgccagcctgccgatttcagcaccacctctcttgcggcgggttccgcatggcagggcggtatgtgaaaacgcctacgtccaccgtgcatctaccatctcaacggaaggagtcttgtgtgatgccttacgccattatgcgcttcgagaaacgaaaaggcggaccggcctctgccatcgagaaacaccacgaacggaagaagccacgctatgccagcaaccctgatgtggacacagaccgctcccacctcaactaccacctggtggagccccgacacaaatactacgcagagatccagtcccgcatcgaacaggcccagcggaaaaatccgaagctcaaggtgcgccgggacagcgtgaagttcatcgacaccatcgtcaccgccacaccggactacctgacgcagctcccgccggaacaggtgcggagatacttcgagcgggcgctggagttcttcagcagggaggtgggcgcggagaacatcttctccgccgtggtacacatggatgagcgcaacccacatatgcacctgtgcttcgtaccgctgacaaaggaccaccggctatccgccaaggaggtgatcggcggacgggataagctggtggagtggcaggacaagttccacgaccacatggcggcggagttcccggaactggagcgggggcagtccgccgccgtcaccaggcggaaacacatccccacctggctctataagcagtcccaccgtctcacccaagagatggtggagatccgcgccgagctggagcagaccggcacactgaacgcgaagaagcagagggagaaaattctgaagctgctggacaagtggtatccccagatcaacgcgttcgaggccaagctgaagccctatgatgagcagctccagcgcatgagggacgagctcattcgctcccgcagcaccatgttccgggctctggatgcccaagaggagagccagcaacagaacctggagctcatggatgagctacgggcgtgtcaaacgtttattgattccatcccgcaggacctgctggagcagataaagcagcggcaggcacagcggatggagcagggccaggggcagcagttatatctgtgagcggagttgcctcaccgcctaaacataccgatcaggcataatcgcccgggtcggaagggacttccggcaccgggcgatcattcatgtagtgctccagctcttgggacagcctccaggccagatggaagccgcaaagaaagctgtccagagattgcgcttcggcgatcttatccttggcgtcgatgatccgcagcaccaaccgcagctccgatttgtccagccgcttgatcagctcctggtggcaggattctgccttctgtgtagcctcagccatgggcagcggcgtgtggaatttatcatagccctttaggggcgctacaacgcgggactgcagattttttctcctttgcttttgtggactgcatgctcgcgctgtgggccggttggatcagccgatgccgccccaccagatgcccagtacgaagcaggcgatgcacagggggacaaagacatacttgccgaagggcatgaaccacttcataatgggcttgtcggagcccagctgagcggcagccagggcatccttcttcttcatgacccagaagaacatgatgccggcggccacagcacccagcggcaggatgtagatggagacaatgtccatccactgggaggtccagggctggatcagcagggccacgatcaggcccacgacgtggatgaggcccacggccatccagcgcttcaggtggagctgctgctgcaggaagttgacaggcgtctcaaacaggttaatgatggaggagatgcccgcaaagaggatggccacgtaaaagaagatgacgatcagtctggagatgccgccaatgccgttgaacacagggagcacggagacgaacatcaggccggggccgccgttgcctaggtcggcgccggtggtggccatagcggggatgatgacgaacatggccagcagggcacaggaggtgtccaggatggcgcagatgacggcggactgacggatcttcacgtccttgcccaagtaggagccgtacaccacggagcccgagcctgccaccgaaagggagaagaagcactgtccgaatgcgtagacccagacctcaggattcaacaggctcttgggatccagagtgaagatgtacttgtagccttccgcggtgccggggatgaagatcatcacgatggccagcacgacgaagaggacatacaggatgggcagcatgatcttgcaggaggcctcgatgccgttggagatacccgccagcatgatgacgaaggagaccacgatgccgatgatgatccacaagttgttggcgccgccggtggcgaaggtcatctggatggcctcaggcaggctgttcgcctcgggggccatagcgctgaaggcgccgccgatgacgttcatgtcggtgcccatggcagtgagctcgccggtgatggccatcttagtgtaggcaaacacccagcccatgaccacggagtagccgatggccaggcacagggagccgatcacggggatgccgcccagccactcgccgatcttcttggggtggccgccgttctccatagccttaccaaaggcgccggaggggccgctgcgggcccaacggcccagagagaactcctccatcatgccggactggcagatgatgaaggcaaagatcgcataggggatcaggaaggtcaggccgccatatctggagaccagcatggggaagcgccacacgttagccatacccacgcaggaacccacagcggccatgataaagccaaactgcgacttaaagccgtcttgtttttgtagtgtatcggaattcgccataaattacacctctcattctttccccgccgctctaaaaaagcagcttcgaaacaaaacctttgcaatacaaaaggggccggtgtccgtcaaacgaaattttttgtttggctaacgccggtccccctttcgatctgcatcgttcctcgtcatgcagtcacgcaaaattgtgccgggaaaagaaaggcgcccaacaaacggactattctgtttgttgggcgccggtttgcctgatcgccgcatcgttcgctacgtcatgcggacacgcaaaattgtccagaattccgggggaagagatgcttacttcttctcctcgttggggtagggctcgaggaaagcgtggaagtggcgcatggggagcttgtggccccagacgatgcgcatgttggggatggactctcggtccttgtacagctgagctacagcggcgatgacgtagtctaggtgctccttggtcaggcggctgcggtcgatggcgaagcggaccacgttggccagctcggcctgctgctcgggagtcttcaggtcatactccatggagaagtcgcccagctcggacacgcggataccatagcggcggatcagctccagagagaagccggtgccggcgaaggtggtgtgatcgcgcttgccgtcgaagaactcgtccatgttgatgtacacggcgtggccgccggcgggcaggacgacgcccttgacaccgttcttgtagaagccctgggccaggtactcgcactgcatggcgcggtcatgctgataggcaaagtcgcaggactcatagaggccggcggccagagccattatgtcacggccagacatgccgccgtaggagtcgttgccgtagcaggagatctgcttgaccttgatgagcacgcccacgtcggtcttgacggtgccgtcctcgttgaagtcggagaacttctgccagaacaggcccttgtcgcggaaggccagcatgccacccatgttggcgtggccgtccttcttggcggacatggtgaaggcgtcgcagtaggagaacatctcggtggcgatctcggcgatggacttgtcctcgtagccgggttcgttcatcttgatggcgtaagcgttctcagcccagcgggccacgtcgaagaccagaggaatatcgtacttgtgggccacgcggttgatctcgcggatgttggccatggagacaggctggccgcagattgggttgttggtgatacaggtgaagatcagggggacgttctccacgcccacggcgttgatcagctgctccagcttctcgatgtccatgttgcccttgaagggattcttctcgtacttgccgccctcggggatctcatatagcaactccttgttgtacaggttgcgggggatggagcccatctgcttgatgttgccctcggtggtatcgaaatggccgttggaggggatggtgaaaaccttgccgggatgacgggcggtcagaatcttcttcacgatctccatcagcacagactcagcggcacggccctgctgaatgataaaggcgttggggcgctccatctgagcggcgccgccgttgaacaggccgccctcgtactcgcagaggaacagatcgtccatcatcttctccaagtcgcggcagtcggtacggaccaggtcgatgctcttcttccaattcttctcgccgccgcgctcgaagatgtcgcggaaggtgtccaacagtacatagtagccggtgttgcggccataggcctcgtcgcccagcatcagggtggcccactgctggttggtcatagcggtggtgccggagtcagacagcatatcaacggtcagcaggccagcggggaaggcgaactcattccagtgggtggcgttcagggcgcgctcacgctgttcaacagtagcctggggcagatcacgcacgacgtacgcgcagtgctgcggcatctcaacatcatgagccagaggatagtgcttcacattcttgtccatttcgtttacctccatcatttaggtgcagtgcacctttgttttttagaggataccccggtcgtcggaagcgggctgaacccaactccagcaactggcggacagtaaccttcctgaacaaaaaatcgtgtacgggaacctttgcttacagcgcggcggtgacctcgatttccaccagagcgtccttgggcagacgggcgacctcaacggcggaccgggcgggatagctcccctcggtaaagaacgtggcatacacctcattcatggcgccgaagttgttcatgtcgctcaggaataccgtggtcttgaccactttgtccatgctgctcccggcggcctccagaatcgccttcacattggtgagggactgcctggtctgggcctgaatcccctcggggaacgcgccggtggcgggatcaatgggcagctgaccggaagtgatgatcagtccattgagggtcacggcctgcgcgtagggcccgatggcggcgggcgcgcggtctgtgctgacaacttgcttcatagtctgggttccacctcccttcaactgcaatgattttattacaaggagaatagtatgtcaagatagaattgttcatttcgttgaaaagcatattttatgatgtgtattttgtgtaaaatagcgacaacaaaagagttatattgcaataataaattttagtcataataagttattcaaactctttgacaaagcacggccctattattataataggtgtaagagaaatctctcacactgtggaaaaatgacggggggtagcgaatgtggccagccagttgctccagcagtatgtaaaattgaccgaatttctcggccatacactgggcccggactatgaagtagccctgcatgacctgacggatcggaaccgatccattgtggctatcgccaacagccatgtcagcggccggaaactgggggcgccgctgaccaatacggcgctgaaaatcctgcgggacaagagctatgagagtcaggactacctgcttcactaccgcggcgtctccgcagacgggcggatcctgcgctcttctaccttttttattaaacagaacggcaaactgatcgggatgctgtgcattaactttgacgacagccgctaccacgcggtgagcgaggagattctgcgcctgtgccatccggataaatttgtggatacgaattttcaggtggacacaagccggatcgacgagctgtccgccatccccgccccgccgccggagcgtttccacagctccagcggatcggtggcggaggaggccgtgtaccgggcgctggaccggctgggcctgtccccgctgcgcctgacgccagaggagcggatggagatcatcgcgggcctggaggccgacgggatcttcccgctgaagggggcggtcaagccggtggcggatgcgctccagtgctcccaggccagcatataccgctacctgtcccagatccggcgggaccggacgggacagcacaatcaagcggaagcggaatagcgcgaggcatgccggcagcccggagggcacctttcatgagggaatcggcagaaacaaaccataaaaataaaacagtgctgggaggagacatcatggtaagggaactgacgcgggagagaacggaggattttcagaccgcctgcgcgtatgagcgggtgtttggctcggaaattctcaccctgctgagggtctacggcctggaggatgatcaggtgcgcttctacctggaggagcaggaggggcgtccggccgcggccattgccctgcaggaccgggcgctctgggtgtcggtccgccccgggaccggggtggaggatctggcggtgctggctcagagcatcgacggcctgctggaggtcaacggagatctggccatcgcccaggccctgcagcccatcctgggcggcgagatcgacagcagcgtctacatggtgtaccggggggagatgccgccggccgacccggcggtgcggctgggcacccgggaggaggtctttgatctgctccagcggggacacccctacttccgggcccaccacgccgacttcgccccctgggcggaggagatggcccgcaagcaggagctgggactggccgagctcttcgtcatggaggcggaggggcagctggtgggcaccggcagcatcggcgccgaggatgacgagtgcggcgtgatcacctccgtgtcggtggttcccgaattccggcgccggggatacggcggccgcattaccagcgcggtgacccggcggatcctagaaaagggcaagactccccggatgaacgccggctatgaggaggtggtccgcctctaccgcagcctgggctttgcagactgtgggaactggggctgcctgtacctgaaggggttgcccgtatgagagacggttatgtccggcgcatcgcggaaaacgccctgggggcgctggtcagcgcggtgggcatcgccatgatgctccaggccaacgtgggcctggagccgtggagcgtccttcaggagggcatgtccaacaccatgggcatcacctatggcacggcctccatccttgtgggggcggttatcattgcggtctctctgctctgcggggagcccatcggcctgggcacggtgctcaacatcgtgctgtgcgcggtatttatcgacggcatccaggccatggggtggatcccccagatggacacgctgtgggggggcctactcatgctggcggccgggctggagatcctggtcatcggcacctggctctatatgcgcaccgccctgggtgccggccccagggactcgctgatggtggccctggcccgcaagaccggccggtcggtgggcatctgccgggccacggtggagatcgccgtgattgcggcgggctggctcctgggcggacaggtgggcatcggcaccgtcatctcggcggtggggctgggctccctgttcaacctgaatttcaaactgcttcacttccgggcgtcggagctgcgccaggagagccttctggagacgctgcgcaatctgcgccggccgggccggaaggcctcctgagcatctttctccctttcatacgcttcggaccgaaaaaggagggactctatgcagctgcagcagctgatttactttgtgaccgtggcggagcagggcagcatcaacaaggcggcggagaagctgttcatcacccagcccaatctgagcaaggccatctccaacctggagaatgagctgaaggtgcgggttttcaaccgcaccaacaagggcgtggccctcaccgacgggggcaagaagctctaccagtacgcccgcaccatcctcaaccagatggagctgattcagggcctgtcccagaaggatcggccccggaccctctccatcgccgcctatcccatcatcaccatgggccggctggtggcggagttccacaacgcccaccggcaggacaccatcgagatcaagctggtggagcagcggctgcagaacgtgatggagagcgtggagggcagccaggcggagatcggcttcgtcatggtcaacaatgtccagctcaaggagttcaggcacaccaccaactacaagaatctggagttccacctgctgggcaaggacacctggtacctgaacgtcggcccccacagccccttttacgaccgaaaagaggtctatatggaggatctgctggactccacgtttatccgcctgcctgacgactacttctccaacctggcccactacctgaagatcggaggcatccctttgggcaagatccatcgaaggctctatgtcagcgacagcgccgccatcctggccctgctgcgccagactgacgtcatccgttttgggcccgccctcagcgcccccgacttcgccgagtacggcatccgctccatccccgtgcgcaactccggcgttgagatcagcatcggctggatccagcgcaagcgggagctgctcacccccgaggcggaggagttcgtgggcctgctgaagggcctgtttccctcccccggggcggcagatccggagcaatatccgatataacttgctattcatattttttatgccaaagttataaccgcgtgggaatatgtgttcaaaacgtcgaaaacagtttgaaaaccctacaaaaagaacggcactgtatttggttacagtgccgttctttttgtgcgaattgtataaaatcaagcccgctttattgccttttttacaagacgctccggttatagctgcgttataactatttcgcgttggacatcatgaaaaattgcatgatatgctttttgtgacaagaaaatcgcgaaaggatgagggccttggaaccgattatcgctctgactattctgttctgcgtctatgcggcgggtgagctcattgcccagaagacaaaggcggtcttttccaccgtgctgggtattgcgatcctgctcctggccggcttctggagcggcattctgccccggtcggtgatcgaggatgcccaggtcaccggtttcggcaatgtcatcgcgggaatcctcattgtctccctgggtaccaccatcgacttccccgagctgcggcggcagtggaaagtggttgtcacctccctggtctgcgtcgtcggcgccaccctggccatcatcctgatcggctatcccctcatcggcaaggagatggccctgtccgtggcccccatcttcgccggaggcagcgcggccaccctgatcatgaccaccgccctggacgagatgggcctggtgaccgccagcaccctgtgtattgtgatgtatgtggtgcagaaattcatcggcgtgcccattgcctctctgctgctgcggcgcaccgccgtccagttccgggacaacccggcgctggtggccgagtacagccagcagcaggagaccgtcgccggctcccgccggggcctgctccagctgcccgcctccttcgcacgcccctctgtctatctggccaagctgggcctggtggcggtggcggcccacttcctctctgagctcaccggcggggtgatccactacttcgtcctctgcctggtgatgggcgcggtgttcttcgccctgggcttcctggagaagggcatcatgtccaagacccagtccggcggtctgatcaccttcttcgttaccatcctgatcttctccaatctggccaccacgaccccgcagcaggtgctgtcggtcctgcccgccctgttgctctccgcggcctgcggcgtggccggcacggtgctcctgggcttcatctgcgccaaagtgatgaacttccccttcggcctggccgtctccttcggcatcagctgcaccttcggcttccccaccaccatgctgattccccaggaggtggccgaggccttcggccgaactgagacagaaaaggccgccattctcaactacctgttacccaagatgctgacagcgggctttgtgacggtaaccatcgcctcggtgctcattgccggcgtggtcgtccgcatgctgtagctgatagagaccgtaaacaaaggaggaattattatggaggaactgttcgagcgtatccgccagtatgtggatggacaccatgacgaaatgctggcgctctgggaggaaatggtgaacaccgagagcggctcccgccagttggagggagtggccgccatggacgatatcctgcgcagggagctggagagtgtgggcgccaaggtgcgggtactccccgtggagaacgctggcggcgtactggtggccgagtggaacagcggcagccccaaggcccccctgctgttcatcggccatgtggacaccgtgttcaagaaggggacagccgaggacaaccccttccgcatcgatgagcagggcagggcccacggccccggcgtgctggacatgaaggccggccttgtcattgccgtccacgccatcaaggccctggctgccgccggctttaccggccggcccgtcaagtgtgtctttgccggtgacgaggagaatctgcatatgctctccaatgccaagcaggtgatgacggaggagatcaagggtgccgcagccgcattcaacttcgagaccggcttcccggacaaccgtctggtggtggggcgcaagggcggcggcccggtatccctgacggtccacggtgtatccgcccactccggcaacgccccggagaaggggcgctccgccgtgctggaggccgctcacaagatcgtagcgctggaggcctgcaacgacatttcccggggcaagctcatcaactgcggcaagatcaccggcggcatcggagagaacaccatcccggatttgtgcaccatcagtatcggtgtccgctttccctccacggagatcaagaacgagatccttgatgccctggagcaggccgcgtcccacagtaccgtccccgacacctgggcagagctggacaccagccgcctgatggagtgcatggacaccaccgacggcgtcatggccctgttccgccacatccagcgcaccgccgtcaggtgcggtatggacgagcccggctgcttccaggtgggcggcctgtccgactcgggcatcaccgtggcctgcggcattcccaccgtgtgcgccatgggcgtgcggggcgagggaaaccacacccccaccgagtatgctgaggtggagtcgctctttgagcgttgcattctggccgcctgtgcggccggctctctggaggacggcttcacggagcaataaaacctgtgaaagaaggaggaaaaatcaccatggaagagaaaaaagcaaagagtgagaaggtcggcgtaggcgcatggattgcgctcatcgtgctgatcctgatcctctccggcgccttccgcaccatggacggccctatcaaggtgctggacttcaccaacctgtcgggtgccttcggcaccatcggcgacacgggcgccaacctgatcggctcaggcggcaccggcgccaaggacggcttcatggctggcttcaacctgatccccgccgtcatgttcttctgcggcctgctggccgtgtttgagcagctgggcgcctacaaagcctctgagatcctgttccgtcccctgctgcgccccctgctgggcatccccggcaagtgcggcatcgctttcatctccagctttaccggctccgacgtggccgcggttatgacccgcgacctctatgaggagtgctccatcaccgatgacgagcgcaccatcttcgtggcctatcagtacgccggttcggcctgcatcaacaacaccattaccggcggcgcacccctggtggccatcagcccggtggccctgggcccctgcatcctgatcatggtcttctgcaagatcatcggcgccaacatcgtgcgcatcattctgcgcctgtccggcaagaaacgcagcaaggagggaaagacagcatgagcaacgagacgaaaaccgcggccgtccagccggccgccccggcaaaagagaaaaagccctctgtcgtcgataccttcctgaagggctgcgccagaggcttcaaggtgggcattgagaacataacccccgcaatgatcctgggctatgtgctggtgtacatcctccaggagaccggcctgatggacctgctgggtgtggtcatgtcccccgtcatgaacctattcggcctgcccggcgaggccttcgccgtgctgatctccgccttcttcgccaaggcctccggctgcgccaccgccgcctccatgtaccaggctggcaccctcaccctgggccaggcttccatgatgctgcccgcctgtatcctgatgggcaccctgatcggccactacgcccgcattgtgctggtcaccggctccaacaagaagtggcaccccctgctcatcgtgatctgcctgctggacgcggccatcagcttagtaattatgcgcgtcatcctggcgatcatgggcattcagtaagttcggagaggagagaatcagcatgtccagacagcgggggcggcagcttcaggggttcggctgtgtcctgatcgtgaccgtcatgctcattgaccacttttgttcaccctgcaggacaattttgtacttgcctgcgccattgtctccgccgtcgcgctgattgtcggcatccgcgtggtcaagcgggcggacgacaaagctcaggatgaggccgctaggagcatgccagcacaccgcctctgatttcaaggcagcgtggctgggtgttgataaggtaccaaccggcgcagaggggccatctgctcagcgagcatgcagtccacaaaagcaaaggagaaaaaatctgccgtcccgcgttgtagcgcccctaaagggctagacagacaatgtattgaattagaaattgttcaagcagccgaaagggcttgctgtctgctttccacagacggcaagccctttcatcttgctcagtcagattgctgcctgccctagaatatgccaacggtataccagcggcggcacctgattgctactgagttagagcttggtaaaaaatggtgatattcctggcggtgacgaattttaaactgctggaaagtaatttttctgtggtgatcttgacagatttcaagggaaaattgtgccgcctagagagcaaaagacccgccgattgggtatgctgcatttttcaaacaaactcttaggcaagtaaatttcgtttcagcttcggtagcagtcagaaagtctcccctttgtccccccatcccggaaacggtagctccgccgtaattaggttgcgcctggatcaagcgcaaaatctgatagcggagaccataaccaaaaatccatatattttcctcaaaaaagttttgccaatcattctctgtcagtttttcatcagacagcatctgctcaaaagtacgcagtgaaatgattctatcttcatggagtttggcagcagccaatctagttgctatatcaggattattctgggtaagttgattccatacctcttcccctagatcagcctctaatagttttcgaataatggtagccttgtttttgttgttgatcaccagtgttgaagcatctgcgatggtgaaatcatgtgtcccataacgaattccgcgcttttgaagtatcacttctaattcctttagcttttcaaatagaattcgtatcgcatcggttggcaaggttatttttataccatcatccggatggagtgaattgaaattgacggggataagttcctcacatgttccatcagaatttttcctataacgtattatatctctgcggatgccgcccgaatgcattgctgctttgaatactgttctagttctttctgtctcatcgagaacaaactcgtctttaacttcaacaaagttactccctttactctgtgttgttatggtatccatagcagcctcctttcttaatttgacaacaattaatctgtataccatttctattatatcaaaatctttccttataaaatagacctaaatggaagaaaaacttgattcctcatggcctaactgtttttcccgaaacgccttcacattgtaataattcctgcacttagttccgcaaaactcgctcttagcatgggggttatagtacacctttccgcagttcttgcagaccttcagggtgggctttccgtctgtgatcaaagcggcgtagaagaggtagagaacttctttcaaggtttctgtctgccaaataagctgaggtgtctgtccgcaggtcaggcgatagttcagcaccccggaaaggtccaaaaacttacttccagcagccggatattcctctccccgcaccgtgcagaagtgttggtagagttcgatgaaggtcatctggaattgcccaagatcgtctccatacttctggctgttcagcgggcacatggaggcagggagttcatatccttgtgcagcaccataagtgtctcctgtgtagtccagcccgagcaagccgtagtgggccgcaaacgaagcgcacaggctgtccgcctcctgtgtattggcggcaagctggcggcccaaatccagcgcatctgccaccagagaacccggttgctgggtacagtcataggtcagagatgtcgcatccggtgtagggaccaaaaaatgcattccatattgagagatgacatggtagtccgaccaccgggtccacatgacggtcaaattgggaaacatggttttcagatccatgatagttcctccattgtaatacttgtaatcaatatatcatctttctacatcgggtgcaaggaagcacccgcttttttgggcagtcaacccgtcttcggaagtgttgtctctggctggccgccgcccacaagatcccgaagtttctccagcgccttctgccgtagcttggtgatgtttcgggtggtgcacccagctctttcagcgagctccctggccgggatgtcaaatactagattcagccttagaatctcccgctgctgaggcgtcagctcccgcagagctgcgctgagtggatattccgataccagctccggcagatcctcctcccgctgggagaagatgatgtccagccacgcctcctcctggaagaggcacagccgcctcgggatctggtagggctcatcctcacagctacggccgtccagcagagccagatcaaagtcatcccggtgctcctggtgccgccgttcgttgttggcgtcgtactgatccagctcccgaagcacgccctcccagtcctcccgagccgccagcgcctccagccgccggttcagagcgtcctccttccggtcccacatattcctttgcaaaaagtttccctccccggttccgtttttgtcctctgcaacgtctatataatagtcggagtaattgatgtaatcatcataatcaattacaattaaaatgtcaataggggggagagaaaatcatgcgcagagaagaacggcagctggtccgctaccgagccatgttccggcattatccggacgccctgacgccgtcccaggtccaggagatgctggggatcggccggcggatgacctacggtctgctccgaagcggccggattcacagtgtccgcatggggcggctctaccggatccccaaggtggcggtaatcgattacctgtgcgaaaccgaagaaaggacttgaaaaaatcgtccgcccaaggtaacatcacaagaccttggacggacgttttgtattgcgagaggaggaacttatgaaacacagagagatcactggcagtctggccgagcgcaacggccggtacacggccattttgaacctgtacgacgaggacgggaagcggcgacaaaagtccatcgccctgggcatcccggtaaaggggaacaagcgcaaggctcaggcccagctggaggagctgaagcgggcgtatagcttgggcctcccccaggaggggaagacagggcaggagtcccagctgtttgccgacttcctgcgggactggctggagatcaccgcgcccaccatcgagcgcaccacttaccagagctaccgtgggctcatcgccgcccggctggatccctttttccgggcgcggggcctgcggctgcgggaactggagcccaagcacatccgggaactgcaccgctccatcttcgctgacggatgtggtgccaataccgtcatccactaccacgccgtggtgcgtaaggctctccagtacgccgtgaaaaatggtctggtggatgggaatgtggctgaccaggtggaccggcccaagaagggcaagtatctggcgggattctacacaagggaggaactggccgccctgttcgaggccacgaaggatgactccatctcggtggtgatccagctggcggcctactacggcctgcgccgcagcgaggtgctgggcatccgctggagcgccattgacgacgaaaagggcacgttgtccatcaaccacaaggtcaccgagggcatggtggacggcaggcaccagatctacaccgaggacaagctgaaaaccaagtccagcttccgcaccctgcccctgatccccgccgtgcgggcgctgctggacgaacagcgggccaggcaggaggagtaccggcggctgttcaagaagtcctactgcaccgaatacctggactacgtgtgtaccgacgagatgggcaggctgttccgccccaactacatcaccgaccactttaagctcctgctgaaacagcacggtctgcggcacatccgcttccacgatctgcgccacagctgtgccagcctgctgctcagccagggcatccccatgaagcagatccaggagtggctgggccattctaccttcgccaccaccgctgatatctactcccacctggattttaactccaagctggagtcggcccaggccatctccgacgctttcgcagcggagccggagtcggccctcgccctgtgaggtgggtggcatgggccacggatctcttcgggagtcatacccggccaccatctccatgggccagctctaccgtatctgccacatcagcaagcggaaggcccgctggctgctggagcaggggattatcccctgcgtggattccggaaaaaagactcggcgcttctccattcagttggaggatgtgatcatttttctggagcggcgggatgccgggctgctggaggatgccatcccccgaggggctttctccggcggttcccgtcccgtctgcccggcccggcgggcgctggacgaggcccggctgtgcgcctatctcctggaacggtggcagggctgtccggatatgctcacagttcaccaggcatcggagctgtgcggctacggccgttccgcgctccaccactggctggacgccggaaaaatcaagggactgaactaccgcagggcgaccctgctgtccaaggagtctctggcctgctggctggcatcccctgggggacagaacattgccgccctctcggagcaacacctggcctggatgaaggactttcaggcggtaaaacagaacagcggcatggggccgggccctatgccactgtaatatcatctcttatggattgtgtcagaaaaaatctgcttcagcaggtccgtttgcgggcgttggacttgagctgttggacgcgctcctccacggttaattccccgtctaggatcttccggatgcggcgttccgtctcagctgtgacccgcagcccttccatttgggcggagaataccgcttcccggatagcctgttcctttttgatatgttccaaacaaatcaccctgtaaagcgatttgttctcacaaaaaggcggagcatccatactggatgctccgcctttttggggcagagccccgttctggcgcagcgggagggattcgaaccctcgtgcgattgctcgcaaactgatttcgagtcagccccgttatgaccacttcgataccgctgcatatcaaattgtgagaacgcaaatcaggataactgtgagcattttgttagcgtttttccgaagcgccgctcacacccgcgcccggaaacccttgggagacatagcttttttgctgttagcacgtcccgccgacgtagcgatttcgagtcaagctcgttacgaccacttcgatacgcttccgtatagaatattcgatttattcaatcctgtcacatgattttgagtcagctccgttatgaccacttcgataccgctgcaactggctgtgggcgggtagcgtcacaaagccacaatcaccgtattgattagaataccctatttttgtgcgcttgtcaatattgcaggggcgtgtaaaatagtttataatcttattcagaagcattgaaaccgtgcattggacggaagggagtaccatggaagaattaaaacgacggattttaagcgatgcggtggtcggcgagggggacatcatccacgtggacatgttcctcaatcactgtatggatataaatctgatggagcacatgggaaacgcgctggcaaagcgtttccggggtgtgaggatcaccaaggtactgactgcggaaagctccggtatcgccttggcctgttttgtagcacgagctctggatgtcccggcggtctatgcgaagaagttccagaccgggtacatcgatccggaggtctactcggccgaaacccactccttctctctggagaagtcctataccctgcgggtctctaaaaagtacctggacggggacgacgtggttctcctggtagacgatatcctctccaatgggcaggccattctgagcctgctggaactcgtctccaaggcgggcggcgaggtggccggcgtgggcgtggccatcgaaaaggccatgcgggacggcggccgtgttctgcggcggatgggcatccgggtggaggccctcgccacggtggagcgcatcgagggcgaccgcatcattctgaaagattgaggaatcgggaaacatggcagacgaagcacagcttgacgcaattgcaagggcaaacgcctttgccgtctataacggtatcacgacccatcaaactggggacggcacggcggaggccatcctggagatcgggccggatagtctaaacccctatggtctgctccacggaggggcctactacacgctggccgactgtgccgccggaagcgcctgccggaccgacggccggaagtatgtgacgctccacggcagccttgatttcatccgctccgccagagcgggtcaggtgaccgcccgggcccgggtggagcaccgtggccgcaccacctgcctggtatccatcaccgtggacgacggagcgggtacggtatatgccagcggccgcttcacctttttctgcaccggcaccctctgagcagaggggcgaccgcccggacggcaaacgctgtccgggcggtttttgttcctgctactgcccccgccaagcggccaccgaccaggtctgccaatgggcggcctgccacctggcgctgtcccgaagcgtctccaccgcctggcgcagctctgtctcctccggctgggcctccagcagctcctccagcgcaggcagggcccccagccgtccgtccgaggcggagagtaccgccccggtgtccaggccgcggccaatgttgtagcgggccaccaagtcgtccacattggcgtagttaaggagcagccagcccgccgcccccacgctcagcagcacccggaaccagcggaagtgccggtgccacaccttccacagggcggctgccaggagcaccgccagcacggccatcccccaataggtcagcacccgcttaaaggacaacccataggcccccacatagaggttcatgcgccacagggcggataccagcagcacgccgctggccgccaccaagagtgtacccagcacctgcaccatcctgagcccccgccccttacccttgcagagagcaaggcaggccagcaggcaggccaaattgaccgcggctacggccacaagctggaaaaaaccgctgcgggcatagctcgcatagctgattcccacctgggccaggtagtcagcgccgccgaacagcgctgcgcactgcaccgccagaaagaaggcatacaggacatccagtactgccaggacggtgaccggccctgcggcctccattgaaagtccctccacgggccgggtaagccgcttcagcggctccggccgccgcagggagtagagcagcccgaacaggaatggggcgacaagcagtccgaaaatcaaccgcagggcccacagcgccagatgctcatcaaaccagtccgccgcccggcgggtcacctgggcgaacagcgcatccgccgatgtgagcaggggaaagaccaccatcagcagtggaacgcacaccagcagtgcccccaggacatagggcatctttttgcgggagaggccccgaatggagcccagcgcctgaaccggcgcacccagatagccgaacaggccgcccatcacccgcaggaaacgctcccccaacatggcggatgtctcaacggaatacacctccatccccggccagccccccatttgaattcccatcagcaggacgatggccagtgtgttccacagccggagccacggattggcaaacagggcaaaggtcagagccaacaggcccacggcgtacagaagaaggcggttttcccgcctggccagcggggcggcgccgccgtaccagaacaggacgccataccatgccgccgccaggagggtcatccccaggccggacaggccccagagcagcacctccgcgcacaggacgcccacgccccatgccagaaccagcagtgcccgatccctcccgtccactggaaacacccgccgggccgccgtcacgggcggcgttaccgggatagtctttttctcctccatttgtctcactccttatatctggtacggagccatgccgcagcgttgagcgccagggttccaaggaccagagcggcggcgctgagggcgaaggcgtgcgctgtatcctgaatggcggacaagtcgcccgcctccacctccaggtagacatggagaggcaccagggacagagcgacggcgcagcaccccagactgggggcgcacagtcccgtccggcgggtcatcagggctgccaggcccaacacccatgccaacaggcccagcgccagcgggccgagggtgctcagatcgtccattccgacattcctcctgtctcaagtgtccagctcctggtagtacaggatgccggtatctgggtcatagaccgcaaaggtatagttgtaagagtaccgctgccacatatcctccgtctcgtcctcctgacggtcctccagataccaccatccccgggctggcacgggccagtccggccagtccgacgcgccggcgccgtccgggtagaggcgctcctccagttccggctccatgggaaacagactccatcccgcgctggatacggcctcctccaccgccagggcgtcctcttgggaaaaggtcagctccatgtggagcaggccgtccccgtggaagcccccgtggctgtccccggaggtgactgccgccggctgcggcagcacaatatccaatttccgggccacgtaaccggcgtccttctccccaccgcagcccgccagcagcaggagtgccaacatcatcgcaatccatatccgtatcataaagcaatccctcctgtctgtctctgaggatagcacaggagggattgtttgtcaatttattattatcgaatttcaataatatttttttgaatataacaaaaaacggacagtcaaaggccacccctacgggtgttctgctgactccggcacgtattccagcaggtcgcccggctgacagtccaacgccttgcagatagcctccagtgtggtaaagcgcaccgccttggcgtggttatttttcaggatggacaggttggccagggtgatatccacccgggcggagagctcgttgagactcatcttccgcttggccatcatcacgtccagattgacgacaatgggcatggcttcccctcctcaaatagtcagatcattctccgccttcagctccgccgcctggcggaacagcgcggacatgaccaggcagagcaggccgcccaggataaagatggggacgaacagggcgttataggtcagcaggggcgcgacggaaccgtagtagaacagcccccacaccacccgtgccagcgcggcggcggcgatcaaaaagcaacacactgccgcccgccggaggctgacgccgttctccgcccggaaaggggcgcccgtcaggatggtgcccagcacccggcggccctgccacaagattacggcggtgcagatgccgcagaacagcaggaacagggcgaggactacctcgtacaccccggccgtccacacccagccccagctcaggacaaacgcgatccccacccgaaggggaacctccagcgggttttcgtagggtgtcagggccaggagctcttccggccctttcatcaggctcattccgggcaccagcagcagggccaccagattacacacaagcgtgatggtcaccaacactttcagagctccagccagcttctgcacagcggtcttttccacggtatctccccctttagggagagtataccatgggttttatcgattttcaacaaaaaagtgaaagggcgtccacgtggacgcccttctgttatacccgaatggctcccagtacttcgccgagagaggcattgatgaccaggccggcctctctgtcgtagggggtggcgctcttgttgatcagggccagcctattcccgcggtaatagcggatcagccccgccgccgggtacaccgccagggaggtaccgccgatgatcagcatgtccgccccggcgatggcctccaccgcgcccaccatggttgtctcgtccaggcactcctcgtagagcaccacgtctggcttcaccaccccgccgcacgctggacagcggggcacgccgccggtctccagcaggaagtccaggccgtagaaccggcggcacttcatgcagtggttccggtggacggagccgtggagctcgtacaccgttttgctccccgccgcctggtggagcccgtcgatgttctgagtcacaacggcggtcagcttttccgccgcctccagctccgccagtttccaatgagctgcattgggcctggcctgcggaaagagcattttgctgcggtaaaatcggtagaactcctccggattccgctcaaaaaaactgtggcttaaaatcgtctccggcggaaatgcgtattgctggtggtacaggccgtccacgctgcggaagtcggggataccactctcagtggacacccccgcgccgccgaaaaagacgatatgccggctctcgctgatccagtcctgaagctgtttgagttgatggtccataagagcgcctccttgatgcgggccgatgtgggcatcggctcctatgtcctgcggtggcggcagcgggtgtgggggcaggacgggcatccgccgcagccgcacccccgcttgcccttcagactctggtggaaacggtagatcaggtaggccgccgcccatacgatcagcgccgccacaccggtatatacgatatattttaacatcctatcacccgcagcacaagagagccgagctgatagaccaggaaggagcccagccaggcggcccccaactgccagccgatggaggccagggtccatttggtggagttcatctccttgcggatggtggacaccgccgccacgcagggcacatagagcaggacaaacaccaggaaggaataggcggccagggggctttggaaggtgccgcccagggcggcggcaatcgccgcaccgctggcagtgacagaaaagccgtagaacatgctcatggaggagaccaccatctccttggccaccagtccggtgagcagggccaccgccgcttgccaggtgccgaagcccaagggggcgaacaggggagccaggaggccgcccacgaagcccaggatggaggactcctcgctggacaccatgccgaaggtcccgccctcaaagccgaaagactggaggaaccagagcagcacactcatggccagaatcagggtacccgccttcaccaggaagccctttaccttctcccacacgtggagggcgatatttttgagggtgggcaggcggtaggggggcagctccagcacgaaggcggcgggctctccctggaaaaccagcttcttgaggaggatgcccgagccgatggcgaagagcaggcccagcagatagagggaaaataccaccagccctccgtattgggggaagaaggcggcggtgagcaggccgtacaccggcagccgggcggagcaggacataaagggaaccagcatgatggtcatgcggcggtccttctcgttctccatggtgcgggctcccatgactgccgggacggtgcagccgaagcccatgagcatggggataaacgccttgccggacagtccgaagcgccgcagcagccggtccataatgaaggccgcccgggccatgtagcctgaatcctccaggaaggacaggaacagaaatagaatggcgatctggggcaggaaggtgagcacgccgcccacaccggcgatcacgccgtccaccagcagggcctccacccacggtgcagtacccgcggcggccaggagggagcggacacccccggcaaaccagccgccgataagggcgtccaccccgtcggccagcatctgccccggcccgaaggtgagggcaaacatacacagcatcatcagcaggaacaccgggatggccagaaccttgtgggtcacgatggcgtcaatgcggtcggacagggtgggcgcccccagagggcggccccgcctgacgcactgggccaccacggtctggatgaactggtagcgggcgtcggcgatcaaggtctcccggtcgcccagatcataggccccctcatattcccggcagacggcctccagctcgtcccgctccctctgagacaggcccagggctttctccaccagggcgtccccctcgatgagcttgatagacgcccagtgggcggggatatgggcggcgtaggccttgtcgtggatcagctcgcccaccttgtgatggatctgatgggtaaagccgtcgtacagatcatccggctcaatggtgacgcccacgtgcatctgccggtgggccgcctccagcagagtctgaatgttctcccctgaccgggcagtgatgggaatgaccggcacccccagggccttggacagccccgccacgtcgatgtggtcgccgtgcttctccacctcgtccataaagttgagcgctatgaccataggccgctccagctccagaagctgggcggtcagatagaggttgcgctcaatgttggtggcgtcgatgatgtcgatgatggcgtcgggacgctcccccacgatgaagtcccgggcaacaatctcctccatggagtagggggagagggagtagatgccgggcagatccaccactgtgacggacttgccttccacctgggcccggccctccttcttctccactgtcacgcccggccagttgcccacgtactggttggagccggtgagggcgttgaacagggtggtcttgccgcagttggggttgcccaccagggccagcttcatctcccgtgtgtcgtggctggcgtagtcgggcacgccgccgtgctccgccgcctcatgggcgtggtcggcatccatccggcggagggtctcctcgtccggaatgtgctgcaccatgccgatgcgccgccgccgtgtctgggcacgccgctccccctccgcgccggttgccacccggatctgggccgcgtccgctttgcgcagggacagctcgtacccccgcaggttgagctccaccgggtcgccgaaaggggctaccttgcgcaccgtgacctcggtgcccggagtcagccccatatccaccagccgccgcttcaccgggccgttttcattgccaacctggagaataacaccgcgctcgcccggcgccacctcctccagggttctctcgttctgttccgtctgagttctcatagccgctccactcaaaaaatttagtttacctaagttaactccttcattatactatggtatccagggccgcgcaagagagggaccggtgctgttttctacaaaaagcaggcgctatggggcgcggtcctgcgtagttccgcaaaaaagagcggacgcccactcggggcgcccgctcagggggttctattagtcgtggtcgtgctcctcacagccgcagccacagccatcctcgtctccgtccccgcagcagcagtcgtcggacagatccagcgcaaatttctgcttgcagccggggcactgaatcacgccctcttccaggacagactcgtcgatcatcagggtgtcgccgcagttggggcagtccacctcaaaaaaatcgtcgtcctcgtcgccgcagcagcagtcatcgtcgtcgtcatcctcgtcaaacacggccttctccacgtcggagaggtcgtcggagatggcgtcgatctcctcgcccagggcgacggtgttctcctccagatcctcgatggacatgccgatctcctccaggatgccgatcattacggagatgagcttgccctccttggacttggcagtgtccagatccaggccctcggccagacccttcagatacgcgaccttctcagaaatagtcataataatctccttttcacaggcggcccaaagggccttcacaaaacgatgcgcctttacagcgtcagctatcacgcctcacaccctccgcgacggcacactgcttaccgctccgcaaaaaacatcttgcgcctacggcacaactgctttttcgtctgcgcggttcgctgtgcgcctgttcccgggcgttcgggcgcttacgccttgcagcgctccagatactcgccggtgcgggtgagccccacgcaaagcacactttgcgcgggaaccctttgatttcatttgcaaggcggaactgaattccgccttgcgccaaggttttgcctccggcaaaacgcttgtgcgcgccggaggcgcgccccgctgcgcggggcccccgacacccgccgatgcccttccgcttccgcggaagcccggcaggcgatcaggccttgcagcgctccaggtactcgccggtgcgggtgaatcccacgcaaagcacgctttgcgtgggaaccctttgatttcatttgcgcggcggaactgaattccgccttgcgccaaggttttgcctccggcaaaacccttgtgtgcgccggaggcgcgccccgctgcgcggggcccccgacacccgccgatgcccttccgcctccgcggaagtccggcaggcgatcaggccttgcagcgctccagatactcgccggtgcgggtgtcgatcttgatcttgtcgccggggttgatgaacaggggcaccttgatctcagcgccggtctccagggtggcgggcttggtcacgttggtggccgtgtcgccgcggaagccgggatcggtctcggtgatctccagctccacaaaagtggggggctccaccgcaaagatcttgcccttataggagttgatcttgcagaccatgttctccttcacaaagcggaagttgtcgcccagcagctcggcgccgatgggtaccagatcgtaggtctcggggtccatgaagtagtacagatcgccgtcgttgtagctgtactccatgtccttgcgctccacataggcctgctcgaacttggcggtggggttgaaggaggtctcggtcacgccgccggtgatgacgttcttcatcttggtgcgcacaaaggccgcgcccttgccgggcttcacgtgctggaactccaccacctgcatcacctgaccgtccatctcgaaggtcacgccgttccggaaatcactggcagtaatcgtaggcattggtattcatcctccaaaataaggtttctcaaaattcagctacgctattttaccccattcttcccttatttgcaagggtttttacagaataatcagctctttgggggatttggtgaggaccatacagccgtcagcggtcaaaaccgtcacgtcctcaatgcggacgccgaatttcccgggcaggtagatacccggctcggcggacaccacggcgcccacaggcagcaaagtctcctcccgagtgttcgcgttgggggactcgtggatctcgatgcccaggctgtggccgtagccgtggccgaaatactccccgtagcccgcgtcctcgatgaccttgcgggcggcggcgtcgatgctcttaccgggcacgccggcctttgtcacggcgatgcccgccagttgggcctccagcacggtctgatagaccttccgcatctccccggtgggctcgcccagggccacggtgcgggtcatgtcggagcagtatccgccgtacttgcagccgaaatccatagtgatgaactcgccctgctgcacctgcttggcgctggggatgccgtggggcaggctgccgttggggccggaaaccacgatggggtcgaagctcatcttctccgcaccgaagcggagcatatcgtactggagcttggccgcgatctcctgctcggtcatgccgggctggataaacttcaggatctcggaaaaggcgcggtcggtgatctcctgggcctttgtcatcagggcgatctccccgtcgtccttggccgcccgcagggcgtccaccagcttctgggcgggcaccagctcggcggtgaggccctccttccagaggttatagtccgccaccgacagatagccctcctcaaagcccatcttccggatgcggcagcggtcgacgacctcctgcaccatagcccggtagttgcggctgcggccggtcatggcgatctccgcgccggtgatgaggtgattggcagcctcaatgtagcgggagtcggtgaagtaaaagcacccctgcgccgtcaccaccacattgccctctccgtggaagcccacggcatagtattccccgggctcgctgttgagcagcatggcatcgaggccatattccggcagcctggccgcaatctgtttcagatgattcatggtaaaaccttcccttctattacatgcaatctgtatagttctctcaagtaaatggcggatacccgcaccgcccgccgtcagccgcaggcggcctggtacagccgcttcatggtcagcgcgtcctccgcctgggtgcctgcgcttgccccagcgggccaaggcccgccgggggccccggccccttcatctgcccgggcgaactgaattcgcccggcatcaaggttttcccttcgggaaaacgcttgtacggcgcaaagcgccgccccgctccggcccctgcgaaagcgcccatcccctcacctctgacttgcctgatacagctttttcatagtcagcgcgtcctccgcctgggtgcctgcgcttgccccagcgggccaaggcccgccgggggccccggccccttcatctgcacgggcgaactgaattcgcccggcatcaaggttttcccttcgggaaaacgcttgtacggcgcaaagcgccgccccgctccgcggggcccctgcgaaagcgccccatcccctcacctctgacatgcctgatacagctttttcatagtcagcgcgtcctccgcctgggtgcctgcgcttgccccagcgggccaaggcccgccgggggccccggccccttcatctgcccgggcgaactgaattcgcccggcatcaaggttttcccttcgggaaaacgcttgtacggcgcaaagcgccgccccgttccgcggggcccctgcgaaagcgccccatcccctcacttctgacatgcctgatacagctttttcatagtcagcgcgtcctctgcctgggtgcctgcgctttcgcagatgaaggtgggactccagccccggcgggccacctccgccatgaggggggcggggtcgggcccgaagtcgtcctgggcgaaggtcaggtgcatcttctcgcccccgttgggggtaaactgaatcttggagaagtggctgtggaaggcgccggcccgctccgccccaagcaccgcctcgatgcggtccagcatggacgcgcaggccgcagtcccctccagctcccccagggagcgggcgtaaaggtggccgaagtccacgcagggtaccagccgctcgtccagggtacacagctccagcacctcgtccagatcccccagttggttgatcttgcccatggtctcggggcacagggcgatgtgtccatagccggcgtcgtcgcaggcggctatcaccgctttcagggagcgcagggcgatgtccagggcctcccgccgcgtacgcttcatcagcgcgccggagtggataaccacccggcccgcccccatccagtccgccgcctgacaggccgcggtgatgtaaccgatggtcttttgcaggctctcggggtcggggtttgccaggttgatgaagtagggggcgtggagggacaggcggatgcccgccgccaccgccgccgcgccgatgttcctggcggtctcctccctgacattgacccccttgccgcactggtactcatagcagtccagtcccagctccgccagccagcggggggcgtctaccgaggatttataaggaaaggactcggcgttgcccgccgggccgaagattgcgctcataacggttttgtcctccttttgctccacatgcggaagggccactccgctccgtagcgcaggtagcgccccggattgcccgccaggcggataggctccaccagcagagtaagcaccccggcgttccgcccgcccagaatgtcggtaaagagctgatcccccacgatggcagtctgctccggcgtgcagcccatctgctccatggcccgccggaagccccccggcttcggcttgcccgcgtggcccaggaagggcacgcccagcgcctgggaaaaccggcggggccgctccgggtgccggttgttggagagcacaaagagggtgatcccctgctctcccagcgccgccgcccagtccctcaccgcctgtgtgggctccggttccccatagggtgccagggtattgtccagatcggctagcaggaggcggatgccccgccgggccagggcggcgggctcgatgtcgaaaatgctccggcccgcccagtgggccaggatgggaagcgccatggtttcacctcttctattctccgtcttgtccgcatataagtgattataccacgtttttcagaacttggacaagggggtacctaagatatgcaaaccagcatgaagcttcttctcaccgcgccgcccgaccagtgccgggccgccctgcgcttcggcctcccagtggcccacgttgcctaccgggtggggggcgggccccacctgttccgggccagcatcccggtatcggtgcggggcggcctgatggtcattgacaacaccggcttcgacggccgcggcgaggccgggcccttctgccaggaggtgctgcgggagtgcatggcccgagggtatgacggtattctctgcgattttgagggccatcccctccaggtgctggcccaggcggtgcgcacgctgggcgagctgaccaaaaagcggggctggcccctctacgtgaccgaggcctacgcccccttttccgactccgccatcgccctcatcccctccgccctgtccggcggctccctccagcagcgccttcaggaggcggtggagcgcttcggcgcggcccgggtggccctggcggtggagcgggtggcggaggacttctttctcccctcccccaccggccaggggatgcccctcacccgggaggagctgcgccagcggctggaggaacgggctccgtcggtgttcttctccagcgagctgtgcgcccactacttcacctacatgtcccggcagaacggggcccacttcgtcctgttcgacgacgcaggctccatccgcaagaagctccaggtggcccgcaatctgggcatctccagcgccgtgctggcctatccccaggtggatgatctcctccccgagctgttgaagtaacccttgtccggcggggcgttttctgctatactgtccttccaaaataaaaaaggaggacagagcaatggattggagaccgtggatggacgcctttctcccgccgctgctggaggccctgcccggccgggtggcctttgttggcatccagggcagcttcggccggggggaggctgggccggagagcgacgtggatctggtggtggtgctggacgcgctgggggcggcggagctggccgcctgccggggtgtgctggagaagatgcccttcgctgaccgggcctgcggcttcttctgcgaccgggcggccctggctgcctggcccgccttcgacgccctccagctcaggctggacaccctcccggtctacggctctctggaggaactgctgccccccatggggaaggagacgctggacgaggccgttcgggcggcggcctccgccctctaccatgccgcctgccacaccgccctctttgacgcccagccggaggcggccctccccgccctccaaaaggcggccttctttgccctgcggctggcccactgccggaggagcggccaatatacggccgcccgccagtccctgctccccaagctggagccggaggagcgggccctgctggggaaggattgcaccctgcccgccctcatggcgtgggccaggggagagatggaatcctgacacaagcccttcccgggatgcaacaaacccccgcgccgaatcggcgcgggggtttgtgattcttagtaatacttcttgcggttcttgcgggcggcctcagacttcttgcggcgcttgacgctcgggctctcgtagtgctcacgcttgcgaacctcggccagaacgcccgacttggcgcaactgcgcttaaagcgcttgagtgcgttctccaaggactcgccgtccttcacatggacttccgacattgacttcccctccctccgaagcggcgggattccaccgccaaagggccacatagatatggctttaacagaaccattgtattcgatccttttgcagttgtcaagagcggattttgatttccagcattctgtttttactgttcctggaaaaacggcggctcctcaccagctcacttcgcaatcaggttgaccagcttattgggtaccagaatggtcttgaccagcttcttgccctcggtgaacttctgcaccttgggatcggccagggcggcggccaccacggcctcctccccgctgtccacggggacggtgatggtgccgcggagcttgccgcacacctgcacggccatattcacctcggcgtccacggtcttgctggcgtcgtaggcgggccagctctgctggcaggccatgccgcccttctcggctgcaaagcccagggtctcccacagctcctccaccatgtggggggcaaagggggagagcatgagcagcagggcggcgtagtcgcccttggagcagccgttctggtagaagtcgttcaccagggccatcagggcggcgatggcggtgttgaacttcatggcctcgatgtcgtcggacaccttcttgatggtcttgtgcaccgcgctctcgttggccttggaacagccggcctcctccgtgaggttctccgccaggttccagacccggtcaaggaagcgcttgcagcccttgacggcgttgtcgctccaggcggcggccttttcaaagtcgccgatgaacatgatatacagccgcatggtgtccgcgccgtactgggccaccacgtcgttggggttgatgacgttgccgcggctcttggacatcttctcgccgccctcgcccaggatcatgccgtgggaggtacgctttttgtagggctccttggtgggcaccacgccgatgtcgtacaggaacttgtgccagaagcgggagtaaagcaggtgcagggtggtgtgctccatgccgccgttgtaccagtccacggggctccagtagtccagggcctctctggaggccagggctttctcgttgtgggggtccatatagcgcaggaagtaccaggaggagcccgcccactggggcatggtgtcggtctcccgcttggcggggccgccgcagcaggggcaggtggtgttcacccagtcggtcatcttgctcaggggggactcgccgtcgtcggtgggctcgtaggagtccacctcggggagcagcagggggagctgctcctcgggcaggggctgccagccgcacttctcgcagtacaccatggggatgggctcgccccagtaccgctggcgggagaagacccagtcgcgcagcttgtagttgaccttggccgcgccgatgcccttctcctccagccactggatcatggcggggatggcgtccttcacggtcttgccgttgaggaagtcggagttgaccaggatgccggtgtcgtccttggcggtgaaggcggcctgctgcacgtcctcaccaccggagaccacctcgatgatctcgcagccgaacttcttggcgaactcccagtcccggtcgtcgtgggcgggtacggccatgatggcgccggtgccataggtggagagcacgtagtcggagatgaagatggggatctccctgccgttgactgggttgacgccccgcacgccgtccaggcgcacgccggtcttctccttgttcagctccgtgcgctccaggtcggacttggaggcggcggccttctggtaggcggtgacggcggcggcgttcttcagcgcgcccccctccagccacttgcgcaccagctcgtgctcgggggagagcaccatataggtggcgccaaagagggtgtccggccgggtggtgtagaccacgatggcgtcgccggtggtggcctggaaggtgacctccgcgccggtggagcggccgatccagttcttctgctgggtcttgacccgctcgatgaagtccagcccgtccagatcgtcgatgaggcgctgggcgtactcggtgatcttgagcatccactggctcttctccttgcggataacgggggagccgcagcgctcgcacacgccctccactacctcctcgttggccagcacgcacttgcaggaggtgcaccagttcaccggcatggtggtcttgtaggccaggccgtgcttatagagctggaggaagatccactgggtccacttgtagtagctgggatcggtggtgttgacctcccggctccagtcgaaggagtagcccagcatctgtagctgcctgcggaaattctcgatgttgtcgtgggtcaccttagccggatggatatggttcttgatggcgtagttctccgtgggcaggccgaaggcgtcataccccatggggaagagcacattgtagccgtccatgcggcgcttgcgggccaccacgtccatggcggtgtagggccgggcgtggcccacatgcaggccctgtccggagggataggggaactccaccagggcgtagaacttgggcttgtcgctgtgattcccggtctgatagactccggtttcctgccatttcttctgccacttcggctcaatggcggcaaaatcgtatttcaaatctctcacgctttctttcgatctgtctcgtccgcgacgggcatataatctgtgatattataatcgaaaagcggccggtttgcaaggggtgtgcttgacttttcccgcttatccagataagatggagccgacaaagaagggagcgtgtatggacatgggaagcaggcgcatgcagatcgtcggaatcgtcctggccgtgctgatggccgccctgctggcggtcaccctgtgggtgtaccgcccggtctcgctggcggaggcggcggacgcccgcaccggactggagcccaaggtggtggttgtggtgcgcctggatgagatggacggggacgttcacacctcctatgaggcgtacgaccccgccctgctggagcagatggagctgctggtggacaccacccggctccgtctggtccggcggagctccatcgcccccctggacggcatgtgtaagatcgtcatcatcggtgaggataacatcatctgctcctttgactacaaccttacaaccaactccatctacatcggggaccggatttacgcgctccgctccacccagtcggcgcccctctccgagctggtttccgccgtctgcggggaggtgtaggccgtgggcttgcaatggaagtatctctggccggggttagtgctggccgccgcactggcgctcgggctgggggccgccttccggtttctccgcccagcctccctgggggagcggatcggcgtggcggagggcgcgtccctccggcaggtagtggtggaacacagcgacggcggcgggcatggctcccacgagagcagcgagcctgctctgctggcggagctgtcctccctgctggcggacacccggctgcgctatgacgggctcaccgacggcggcgtccccgtctcccccgccgcctataccgtcacggtctattccgccccggcagaggaggggcgcaccttcggcgtggacagccaggggtgcgtctaccaggacaaccggcgctattccgcctccccggaacaggcggaggagctgacggccctcctggagcgcatctgctcctaaagccgtccagaggccgcctccttccattctacagcagcacggccgtctctctttacgaaatatatactatacacatttccatcgaggtaagcggcaaaaagcggcgtgcgggggaattcccccgcacgccgccggcctgtgtccccacattcagctcagcgggatggttaccgcctcgtcctccagaacgcggatggtatcgtttggctgccagacccagagctgctccgcccgggccagctccgccggatcggcgtccgggtaggagagcgtcaccgtccacaccccagtctcccagtcataggagcggtccagataggtgtcccccagctccagctcctctccgcctccgtccaggaggccaacctccgtgccgaaaccgccgtactcgtactggagcagctcttccccggtctggaaccgggctaccgcctgctctgccccgatgtccagagagatcagagtataaccggtctccgcggaatcgtcggtaaggggcagttcgtccacagcgccaaagatcttgtgatttccgcctggttcatcaccggggtagacccgctcatagggcaccagagtgatggactccatgtccggccgcccgccatagaaggcgacaaagttcgagacgggcagactgggtctggaaaccatgccatagtacttcttatacagataattgccctgatcgtcccggatgaaaaagttccccggcggatagtctcccgcgccggtgagcaccagtccacctcccgagggggccaccactgccttggacactgtccaccagcggccgtccagggtgattcgctgtccgggctccaccaccaagctctccccgtccggggcggtcttgtccaccagcaggttcaggctccaatccccggacaggccgtaaaacagctcattggtgtagacctgaagctccaccacatcgggcagcgcgcgggccaccgggcaacgctgcatcacctttaatgtatagtcgtccacccactcggtttctcgatcctgatcccagaactccagctcctttccctcagccttcagggaaaaggaccacagctccggctcaccccggtcattcctggggatcggctcttctccggtgatggtggcgtagagtgtaataaacgcctcgtccacaccgatgccgtccagggtgagggtgtagccctggtcggtgaccgacgcccccacctcggcggaatagggctggaagccctccgccgtaccgccgaagccgccgggccgggcgatcagctccagcgcgccggaggccgccgccacgccgcccacgcacagagccgccgccagaacaccggctaccgcccaccggcggagacggcgggggccgggctttctccgtccctccggcagcccctccaaaatggcgtccatgcgcccgtcaaagccctgcggaaccgggcagtcctcccgccgggcccgctcttttaaccattcatccaaccggttcatatttcctcctcctgtagttgctccttcagccgctggcgggcccggcccagccgggacttcaccgttccctgggccacccccagcacccgggcgatctccgccacgggcaaatcctcgtagtagtagagggtcacggcggcccgctgctcctctggcagatggagcaccgcatcccacaggccgccggggagcgcgtcctccgcgccgccggccagcggctccagctcgtcggtatagatcaccctgctgtccctccgccgctgctcataggcgcagttgaccgcaatcttcagcagccaggcgcgaaccgctccccgggcccgcaggcggtcccaggactgccaggcccgcaggacagcctcgcccaccgcgtcctccgcgtcggcgtcgctgtccaggatgctccgggccgcccggaacatgccgtggctgtgctcggtcaccgccgcagcaaattcctcccgcgccgacgcccggcccgcgccgtctctggtctgttccatgtgctcacctcgtctttccttgtccggacaccctatagatgcatgggcgggcggtttggttccctctccgcgcaaaaaaagcccggcgggagtcccgccgggcttttttgcgttagttttcggtcagcacgccggacagatccaccggcgcggcgtcgctccacaggcgctccaggtcgtaaaactcccgggcctcctcgttgaagatgtgcaccacaacggaggagaaatccagcaggatccaggtgccgccccggtggccctccacatggtgggggggctccccggcgtccttgagggccttttcacagacgtcagccagggccttgatctgggtggtggaggtggcggtgcagagcacaaaatagtccgccagggtggtcaggtggccggtctccaggcacttgatatcctggcccttcttgctgtccagcgccttcacggcggtcagggcaatctcgtttgcagtcatctcattctccttctattcaatgggctccatgccgggaccaaagccgtccacgggcacgtcgggcgccggggtggaggcggggatgggcgtgggagccggcgtgggtacgggggttgcggccggggtgggttccggcgcaggcgtgacagccggagtctctacggcggggggctggctctccgccggagcggagggcgtggtctccggcgtcaccgttggcgtggcctccggtgtggccgtcggagtgaccgacggctccggggtgtcgggcacctccggcgcgggattgtcggtgggcttggagctgccggagttccccttcgcggggggcttggtggccttggtatcctccacatggccgcgggtggaggacaggctgccgtcctcgttgacctgcatcagatccagctcgttcagctcgatgtcctccaaataggggttgaagcaggtattcaccagctccagcatctcgtccggaatgggagtaacataggactggtagttgtggtacgtccggctgtagacgctggccccccggttgggcagggtcataaagtgcacattctccatgctcaggccgcccacgatggcctccttggcaaaccaagccaggttgttcaccgtcaggctgccgttggtgtccacgttatccaggaagatctgggccattttggggatggtgccgaggctgatgctgttgaggcacttctcaatgaccgccttcaaaaaggcctgctgggtctcgatgcggcccagatcgccgttggggtagccgccgtatacgtttccataggcgtcggagttcttccgccagcgcaaaagctgcatggccttgtcgccgtcgatgtcctggagcccggcgttcaggtggatgtgcaggttctgggtggggtcgtcgtagttcatgtcgatgggcacatcaaactctacgccgccgatggcatccaccagctcgcccaccgcctcccactccaccacgatggtgtagtccggctgaaacccgatgaggtaggagacctcctccttgagaaattggatgccgtccttatcgtagtagggcgcgtagttgtataccgagttgatgcgcttgatgtcccacggcacgttcaccatggtgtcccgggggatgctcatgacgtttagggtctggtttgggatgtcgtaggccatcaccataagggtatcggtattgccgccgccgcccgtgtcccggcccaccagcaggaaagtataaaactcctccttgcggtcgccggagaggcgggggccctcgccaaactcatagttttggtcctcgtccggccgctccgcacctggctccggcagcgagggcttgaccaccaggaggcggtaggcggcgaaaaccgtcaccagaaccgccgccagaatggccaaaaccaggcacgcaatgcgcagggccttctgcctcggtgtgaggggcgtgcggggctttccagcccgcgttccaccccggcttgtctttttgttctcaggattcatccgtttctatcttcctttattccaccggcaccatgccgggtccgtagccgccgtccggcgtggcggccgggggcggcgtcatggctggggtgttctccgccgggggcggggtcggctccgcggaggggacggcgggcgccggagtggccgccggggtctggaccggaggcggcgtctgcccgcccggagtggatatggctgggggctggcttccgcccggggtggacgtggccggcggcgtgcccggcgggctttcgaccggagcggaggttgcgctgggcgtggtctccggcttaggcgtagcctggggcctgggcgtcgtgcccgtgctgctggagccgggtcgctttccggccagattcagatcccgcaggctgatgtccgactgataggggttgaagccctcattgaccatctccacaatctggctgcccacgggcagcaggtgggcgtccccagcggactggttgggcagggtgacaaactccacgctgtccatgtccagcctgccgatggccgacttgccgaagtaggccagattgcccacgctcagatcggtggtcacattcttctggaagatactgatatagtccatcaggttgctcagcagcacatcgggctggaggcacttgcggacgacctccttgaggaatgcctgctgggtcttgatgcggcccagatcgcccatggcgtagccgctgttgagaatgtgcccgctgtcatcgctgttgtgccgccagcggagcacacccatggcaccgttgccgtccagaagctgatagccaggttggaggtcaattttgaagtgctgggacagatcattgtaatacatgcgccgcggcacgtcaaaatatacgccgccgatggcatcgaccagctcacccaccgcctcccactccaccaatacatagaagtcgggggtcacgccggtgagggagcccaccgcctttttcagggcctccacgccgccttcctcgccgccgccccggctgtaaaccgagttgatcatcacggtgcggccgttgtagatgacataggtgtcacggggaaggctcatgacgctgagcttctggttgggcacatcgtaggccgccagcagcatcgtatcggtgttgccgccgctgacgcccgccaccaggaaggtgtaaaactgctccttgcggccggcggacaggcctgggatctccacctctacctcctcaccctgctcgttgatgatggtggtgtgccggggggtgggagtggggagggccacctccggcggggcgctcatgaggccgaacacaatcgcccccgccacgatgatggccgccaccaccgtcagggcaatatacagccccagcagaatcttctgctttttggtgcgcggccggccgggctttttctcccgcttggtctctttttcccgccggggactctccggcttctgtacccgggcgccgccccggtggttctttctctgttccgggttcatcaatcactagttcctttcgtcttgctccgcagccaatcccgggcctttaccgtattggggtgcacgggcaggccccgctccgccatctcctgtatgctcatctcgcaccccaggagcaccgccgcgtccagatcctcataggccagcgcccgcaggcgctccacccccggaaaatcccgggttggctccatgtagtcggcgatatagaggagcttctccagcagggtcatgtcggcctttccggtggtgtgccagaaaatggcctcatagatgtcgtcgctcaccccgtacacgtgccgggccacacacgcgcccgtcttggagtggaggagtttgacggcctgctgctccaattcgtccagtacgataccatatttcgcgcataattgcaactgctcgtccagttccaaatacttggtgcagtcgtggaggatcgccgcccggcgggcgtgctcctcgtcggcgccccagcgccgggccagccgcaccgcctcctcctccgtgcccttcacgtgggcgatgcgcttggcgcggatcatggagtaggagcaggcccgcagctcccggtcgggcaggcgcttcagatcccgccccgccccgtagagcccgtggcggaggatatagccgtacaccgccggggacaggtactcccaaccctcgccgcgggccagcagctcccgcagccgggtggaggacacgtccaccacctggggcagttggaggacgcacaccttcgccccgaaggtcttgcgcagatgctcggcctggatggtgagcagctccccgcagtcggcctgggtgcgggcaaaggcgcagatgcccgccagggcggtgatccgctccggctcccgccagttctggagggtgaggaacatgtccgtccccatcatcagccacagctccgcgccggggttctgggcgtggagctgcgccagggtgtcggcggtgtagctcttgccggggcgggagagctccatgccgctgacgctcacccggccgggcaggagcaggccgtcggcggccagctccaccatctccagccgggcctccggcccgggggcgtcggggggcaggcgcttgtggggcggcagcgccgccgggacaaaccgcagctcgtccagccccagcgcgtccagggccagccgggcggaggtcaggtgccccaggtggggcgggttgaaggtgccgccgtagatgccgagcttcataggcttcccctcctctgcgttacttgcgcttcctgtccgtcaccagtacgatcttgtcctttttgtccttcttatgggttggacgatacaaaacgaatttggttccaatcacctgtaccacctggctccgggtggccgatgccagggcctcggccgcctcccggctgctcagcaggctgttctccaggaccttgcccttgatgagctcccgggcctccagggcgtcgtcggcctgcttcaccaggttgtccccgatgccgtccttgcccacgtgcaggatggtgtcaatgctgttggccagacccctgagctgggcccgctgcttgcttgtcagttcttccatagaccggtctccttttgatctgccctcctgcgggaaggcattttacttgttcagatactgctccagcttctcccgaaaggccgtgagcgcattcccccggtgggagatggcgttcttctccgccggagagagctccgcaaagctctttttcagggcggggacaaagaaaatgggatcatagccgaagccgtcctcccccttgggggcgtaggccaaggtgccgggacactccccccgggcctccacccggtccccgttgggaaagcagcagcagatggcggagacaaagcggcaccgccggtccagctgcccccgcatgttctccagcaaaagccggtagcggcccacgtcgtccagccccggcccgccgtagcgggcggagtacacgccgggcgcgccgttcagcgcgtccacgcacaggccggagtcgtccgcgatggcgggcaggccggaggcctccatcaccgcgcgggccttcaaaaaggcgttttcctcaaaggtggcgccggtctcctccacgtccacatcgacgcccacctcggactccagcaccacctccacccccaactgggagaggatgtccctcatctccaccagcttatgggcattcttgctggccaataccagtttcatacatttagccccccaacacttgtctctgaatgttctggagctcccggatgcccttggcgcacagctccaccagggcgcgctgctccacgatggtgaagggccggccctcgccggtgccctggagctccaccagctcccccgcgccggtcatgacgcagttgagatccacctgggccgaggagtcctcctcgtagcacagatccaacagaagctcgtcccccacgataccggcggacaccgccgccacacagttggtcagcggcatctctggcaggacaccgtccatcaccagcttgtgcagggccagactcaacgccacaaacccgccggtgacggaggcggtgcgggtgccgccgtccccctggagtacgtcgcagtcgatcgtaatagtgcgctctcccagctttttcatgtccacgcaggcccgcagggcgcggccgatgagccgctggatctccgcggagcggggggacagcttcagcttggcgatatcccgccgggatcgctcccggttggcccggggcagcatagaatactcggcggtgacccagccctccccctcggggacgtggcggggcgcgccctcctccacgctggcgcagcagagcacatgggtgctgccgcagcggatcaggcaggagccctccgcaaattgattgatgttggggatgatctccacgggccggagctgatccgccgcccgtccgtcgattctcgccatgttacggcctccaatctccaatatgcgggccgatgagggcaccggcccatactgctttttaaacaagggcttcgacaaatttctccgcctcaaaaggcatcaggtcgtcgatgccctcccccacgccgatgaatttcaccggcacctgaagctcctgggcgatggcaatgacaatgccgcccttggccgagccgtccagcttggtcaggacgatgccggtgatgcccgcggcctccttgaactgcttggcctggatcaggccgttctgtccggtggtggcgtccagcaccagcagggtctcccggtcgcagccgggcagctcccggtccacgacgcggctgatcttgttcagctcgttcatcaggttctgcttgttgtgcagccgcccggcggtgtcgatgagcaccacgtcggcgctgcgggccttggcggcggtgagggcgtcaaagaccaccgccgcgggatcggccccctcgtactggcggacgagctccacgccgctgcgctcgctccagatctcgagctggtcggcggcggcggcccggaaggtgtcggcggcggccatcagcacccggtggccctcccccttcatccgggcggacagcttgccgatggtggtggtcttgcccacgccgttgacgccgataaacagggccaccgacggggtggtgtccagcttcagggcgggctcccccacctggagcatgtcggtgagcacccggcgcaggcacgtccgcgccccctccatgtccttgatcttctccgccttcacccggcggcgcagctcctccacggccttcatggtggtgtccacccccatgtcgcccagaatcagcgtctcctccagctcgtcgtagaagtcgtcgttcagctctccggcgaagagctggtcgaaggagtgtccgatgttctccttggtgcgggtcagccccgccttgatcttttcaaaaaagcccatgtggtgttggttcctttcatcgttcaaacatggtattcatcctccgcccagcgggcggggttatgctcgatgtagctccagtggttgagaaggtcgttctcatcccggatgatgtggtcgtgataggaggcctgccagagcggacggccctgcgtcccccgatattgattccatcgtctggtcgtctgcgatttaaacacgcgcatcacatcagggattccaaaatgcgctccctctgtagggcgggggcttgcccccgccgtcatgagtaccagcagcagatggatgtggtttggcatgatcaccgctttttctatctgaagcctcggaaatcgcttaggtaactgctctaactcctccgccgcaatccggccagcggggaggaaacggagtccggcaggggcaagccccgccctacgatctcgcttaaaatcggggcccggccctgggtgcagagtgtgaggaaatacccgccgctccggctgtaatcatacccgcgcaggcgcggatgcacccactttggaagctctgtcacttgatgtgcagctccttctccacgtcgttcagattgatggtcaaaatccggctcacgccctgctccttcgtcgacgcaaagtccgcttcgctcggaactcccgcaggcggaaattcctcgcccgctcccttgcgtctcctctccccggcgaacccgtttcactgggcttcgccggggtctgctcataccctgcggcacaggtgcggcctgcccctgctgggtgttgccgtccgccgcgtccggcgtcatttgatgtgcaattccttctccacgtcgttcaggttgatggtcagtatccggctcacgccctgctcctgcatggtgacgccgtagagcacgtcggcctcctccatagtgccgcggcggtgggtgatgacgatgaactgggtcttgtccgccatctggcgcatgtagcgggcgaagcgcaccacgttggcgtcgtccagggcggcctcgatctcgtccatgacacagaagggggtaggccgcaccttcagaatggcgaagtaaagggcgatggccacgaaggccttctcgccgccggagaggagggagagcaccttgagggcctttccggggggctgcacccggatttcaatgccgcagttgaggatgtcctccggctcctccagctccagggtggccttgccgccgccgaacagctcggtaaaggtctgctggaacgcctcgttgatgacggaaaactgccgggcgaagatggttttcatctcctcggtgatgtcggcgatgatgccctccagctccttcttggacttgagcacgtcgtcccgctggtcggtcaggtaggtgtaccgctcgttgacccgctggaactcctcaatggcatccaggttgatattgcccagaccggagatcgcctttttcagctcgcccacccggcgctgggccttggggacgctctccaactccacccgctgggcgcgggcggcctcatgggacagctcataggtctcccacagcttgtccagcagggttttctcctccagggcggcggcggccttcctctgttctaagacggagacctcccgctctaagtttaacagttcgctgtttttttcccgcgcctgcttgtcggcctggttgcgccgggcctccaacgccagcttctcctcattgatgcgggcgatggcctcctgccgctcccggttctcctggcggatggcctggagccgccgttccttctccaggatctcctcctccagggcggcgttcttctcctcaaacgcggtgagcatccgctcccgctcggcccggtcgccggtgagatcccgccgcagggcctccagctcggtgagactctgcccggcggcctgctgctccgcctccaggccggcccggcgcatgttcagctccgcgatggcctcccggataccggcggtgcgcgcctggagctcgctctggccctgggccttgccctcggcctcggcccgcagggcggcggccgagccctccagggcctcaatgcgcgcccgggcggcggcggtatccgcctcggtctgggcggagcgggcctgaatctgctccagctcccggcgctgctcgtcccgccggcgggaggcatcggtgagctgggcgtcgaaatgggccagccgctcctccagcttgaggatggcgtcctcgtgctggcgctgctgggcctgggcggtctccacctcgtatgcggcggcggtggcctcccgcctggcctcctccatggcctgggcggcggcggcgcgctgctcctccacaccggcgcgctgccggttcagccgctccagctcgttggcccggctgaggatgcccgcgctgcgggacaccgagccgccggtcatggagccgccggggttgagcacctggccgtccagggtgacgattttgaagcggtggccgtatttgcgggccatggcgatggccgcgtccatatcctcggccaccacggtgcgccccagaagattggaaaaaatcctctggtagcgggggtcaaactgcaccagctcgtcccccaggcccacgaagcccgcctccctccgcacgccctgatcccggaagtcggaggggcggatggtgctcaagggcaggaaggtgctccggccgccgtcccggcgcttgaggtactggatggcggccttgccgtcctcctcccgctccaccacaatgtgctgcatggcgccgcccagggcggtctcaatggccacggtgcagtggtcgggcacgtggagcagcccggccaccgggccgtggacccccttgagctggccccgccgggcctcccccatcaccagctttaccgccttggagtagccctcgtagagcttctccatctcggagagcatgtggatacgggagtggagggcgttctcctccatctggagcttgacatggcgctcctcggcctccttggcttttttccggcgggactccagccgcaggccgtagccgttgagcacattctgaagggaatcccggtcctcccgggcctgggccagctccttttgggccgcgtcccggccctcctgaagctggcgcacccgctcctcaccggcggacagctcctgatgcaccgcctcatcccggtccagcagctcctgggccgcggcggctagggcggagagcagaaccctggcctcggaggcggaggcgttttccaccgcctccttccggcgcagctcctccagctctccggccagggtgcctgcggagcggacggcctcctcggcctccccctgtttcgcggacagctccgccgccagggtgtccagctcgcccaccagcgcctccagacgttccttccgctcggcaatctgggcgccgatggagtcggcccgcccctcctgctgctccagctcccgccggatgcggtcccggttctccaggttgttctggatgttggcccggagtaccgcaacggcgttttccagtccgttggcgtcggcctcccgctgcatcatctggaagcggacgccctcggcctccacgtccttgtcccgcatctgggcggcgtgctcctcggcggcggcgtagagggcctccaccgccccctgggcctcctccttctggcggacggcgttctcgtagtcggacagggtcttgatggcccccgcccgtattttctccaactgctccagccacagggagatctctagcccccgcagctcgtcccgcagcaccaggaacttccgggccttctcgctctgtgcgcggaggggctccacctggagctccagctcgtcgatcttgtcggtgatgcgcaccagattctcctgggtgcgctccagcttgcgctcggcctcctccttccggtggcggaagcgggagataccggcggcctcctcaaagacctcccggcggtcggcgctcttgacggacaaaatctcgtcaatgcggccctgcccgatgatggagtagccctcccggcccaggccggtgtccatgaacagctcgttcacgtccttcaggcggacggaacggcggttgatgtagtactcgctctcccccgagcggtaataccgccgggtgaccatcacctcgctctcctccatcgggaagatgtggtcggtattgtccagcaccagggagacctccgcgaagccctgctgtctgcgcaccgccgtgccgccgaagattacgtcctccatcttgccgccccgcagggccttggaggactgctcccccatgacccagcggatggcgtcggagatattcgatttcccgcttccgttggggcccacaatggcggtcatgtcctccccgaaggagagtaccgtcttgtccggaaaggatttgaacccctggatttccagcgcttttaaatacaaggtctgcacctcgccatgttatcattctgaataaattattataccaaggaacggcgtcctttgcaaacccttttccataaaaacgcggagcgcctgagcgctccgcgtctggtttggtggtatacagcgggcaaaccatttcgcagggacggatacctacatccgcccgccgtacaccaggttttgcactgccccaggccctgtgaaggcctgacaggacgggcggccataaaggccgcccctacagaggagccggacagcccctgcacgtaggggcgacccttgtggtcgcccgcgggccggttattcccccgccctcagcttctctatcgcggccctggccgcgttctgctccgcctcttttttgctgcggccgcggccctggccgatggggatgccgttgagatccacctccaccgagaagatcttggcgtgatcggggccctcggcgccgatgagctggtagcccagcacctggccgctctcccgctgcaccagctcctggagggcggtcttgtaatcgcggctggcgctcttctccgcctcccggtccaggatgaacttctggatgagcttccgggccgagccgatgccgccgtccaggtacacggcggccagcaccgcctccaccgcgtcggcaatgatggagggccgctcccggccgccgccggcctcctcccccttgcccagcttcaggtaggcgcccagctccaggcactgggccacttccaccaggctgccctcacacaccagggccgcccgggtgcgggtcagatccccttctggcaggtcggggtgggtgcggaacaggtagtcggccacgaccataccaagcacagagtcccccagaaattccagccgctcattgctctgcagtcccttggccttgttctcgttggcgtaggagctgtgggtgagggcgttttccagaaaggcccggttggtaaaccggtaacccagcttttcttccaatgcctccatggccgatcctccctttcaaagccggagccccgccgggaggcggggctcctgtctctttggtttcttcagtcctccagcttggacttgaggtagcggaccagatccgccacggtggagataccggacagatcctcctcgtccatgtcctccaggccaaactcctcttccacggccatggtcatctccacgatgtccagggagtcggcccccagatcctcaaacgaggtgtccatggtaatgctgtccacgtccacgccgaactgttcggacagcagggcggcgagcttctcgaaaatcatgttcatctactcctgtcgcttccgtcgttcccgacggtgtcattgcactatgataataggcaagtttctcccgcctgtcaataggaaagtcaaaattttcccatttactcactgcgcaggcgcatgtggtcgatattttcggtgatgtcctcaataatgccggaggccgcgaagctctgggcctggcggatggcgttcttgatggcgaaggcgtcggaggagccgtgggccttgatgacgggcttggagatgccgatgaggggggtgccgcccacctccccggcgtccatcatcttcttgaagtcccgcaggcctccggaaaccagcaccgccgccagcttggtgagcaggttcttcttgaacatggccttgagctgctttgccatgaagccgccggtgccctccatggtcttgaggaagatgttgccggagtagccgtcggacacgatcacgtccacctcgccgtacaccgcctcccgggcctccacgttgcccacgaagtggatgcgcccggccttgcccgcctcggtgagcagggcgtaggcctcccgctggaggtcggtgcccttggagggctcggcgccaatgttgagcaggcccaccttgggctcggggcgcttgagcacccgctcggcgtaataggagcccataaaggcgaactggagcagatactccggcgtaccctccgccgtggcgccgcagtcgatgagcaccgcgccgccgccgccggtaggcaccaccggggccatggccgcccggcggatgccccggatgcgcttgaccatcagcgtggccgccgacaacagcgcccccgtgctgcccgcggagacaaaggccgccccgtccccgttcttcagcaggttcaggcccacggtcagggaggagtccttcttctccttaaaggcggtggccgggttgtcgcacatctccaccacctcggaggcgtggacaatctccagccccgggggcagttcgccgatgccgtcctccttgagcaccttgaggatgtcctccccccggcccaccagaatgacttccacgcccagctcccgcaccgcagcgagggcgccccgcacgttggagacgggcgcgttgtcgccgcccatggcgtctacgatgatcttcatatgttctcctccactttctctgttcattcctggataaacggcagcagcgggcgggcacccggcggggcggggccgcccagcgttcctgtagggggcgatgccctcatcgccccgccccatcgtcttgccgcagaggccggggctcgtccgtaaggcccaggagatagtcggcgctgatgttgtagtgctcacacaaaagggcaagcttggcaaaggtagatgccttgcggccattttccatttcaccaatttgattttgtttgataccgagaaaatcggccaagtctttttgagtttctcccctatcttttcttaggcattttagccgtgtgccaaacaaatcattggaatacaccgaatccccccttgacatttcccactaatagcgtgtatactaaatacacactattagtggggtgttgataaaatgaatgacttcctacagcagctcttagaacatgagctgggtaacaggcacttggatttccgtcaggcccccggctaccaagagcggctggagcgcatcagcgcctgccacgaccagatccgcgcctccctcgggctggattttctcgaccgtctcaacgatctggagggcgaaatgtccgattatgagcggctggcctgcttccggcacggcttccgtctggccgggcgtctcctcatggaacttctgccttgagctgcgggcggatgtgggcatctgcccctacgggcgtgcgcggcggggcggacgtccacaagaggcgcccccatgcgtttgggccgcccagcgttcctgtaggggcggcctttatggccgcccgttctgtccgatccccagggtgtcggtgcgggaaccccgcggtagcgggcggatgtgggcatccgcccctacggacgtgcgcccggcagggcgggcgaccacaagggtcgcccctacgtgttggggccgcccggtgctcctgtaggggcggcctttgtggccgcccctaccgccagtccagcccgtccagaagctccaaggcccgcttggacagctcggcatttttattccgcttgcctttgacgcggtagcccaggggcgggatgatgccgaagttgacgttcatgggctggaagtcggtgacgctctcgttgctgacatagcgcgccagggcgccgacggcggtctcctgggggaagtccacggggggcctcccctccagccgccgggccagctccacggcgaccaggaagccggaggcggtggactccacgtacccctccacgccggtgatctgcccggcgaagcagacgcggggctccttcttcacccggtaatagcggtccaacagccggggggagtccagataggtgttgcggtgcatgacgccgtagcgcacgaactcggcgttcctgagggcggggatcatggagaacacccgcctctgctccggccatttcaggtgggtctggaagcccaccaggttgtagatggtgccgtcggcgttgtcccggcggagctgcaccacggcgaagggctcctttccggtcttgggatcgttcaggccacggggcttgagggggccgtagcacagggtctgcttcccccggcgggccatgacctccacgggcatacagccctcgaacacatgcttgtcctcaaagccgtgaacctccgcctcctgggcggcgcacagctcggcccagaaggcgtcgtactcctcctccgtcatggggcagttgatgtagtccggggtccccctgtcgtagcgggaggcgaagaaggcgttctccatgtccacgctctcgaaggtgaccaggggggccgccgcgtcgtagaaattgagggtgcggctctcggggaagaaggcccggatggcctccgccagcgggtcggaggtcagggggccggaggccacgatcacgttccccgactccgggatttgggtgacctccccctcctccacggtgatgagggggtgggagcggagcttctccgtcaccgcacgggcgaacccgtggcggtccaccgccagggcgccccccgcctccacccggtgggcgtcggcgcaggacaggatcagggagtccatgcggcgcagctcctccttgagcaggcccaccgcgttctccagctgatccgagcgcagggagttggagcacaccagctccccaaaccactcggtatggtgggcgggggtcattttggagggcttcatctcccgcagggtgacggggacgccccgctgggcaagctgccacgcggcctccgagcccgccaggcctgcgccgattacaataactggttccatgggttcctccttgtgtgggactcagcggatgaagtgggtgcgcagaggctcctcccgctccggcaggccgtatttctcccggcccaaggcgatgctcttgaccaggaaggccatgttccgggccagggtgcgcatggtctggaggccctcggtgtcctgggcggcctcgccgggcaggcggccgtggatgctgttccagtactggctggaggccaccggcatgccgctgatggtaaagaatttgttcagctcgtcaaaggtggaggacaggccgccccgccgggccgccgccacggcggcccccaccttcatggtcttgtcaaagggggtggagtaaaacagccgggtcagcagggccaccagggtggcgttggccgaggcgtagtacaccgggctgcccaccaccagcccgtcgcaggcctccagcttgggggccagctcgttcaccagatcgtcgaacacgcaccggcccagctcggcgcacttgccgcaggcgatacacccccggataacccggtttcccacctgcacccgctcggtctccaggccctcggcggcaaacacggcctccatctcgtccagggcggcggcggtgttgcccttgggccggggacttccgttgagcagcagaatcttcatgccaacacgctccttttccggttacacgcccatacacccccccaccagggcgatgaccgccagatgggcgggatagaaggcgtaaaagaaccacttgggaatccggaggccggagtgggtgcggcagaggatcagcggcagggccagcagggcgaagatcgtccagttgacggcgtggccgcccaccaccagggccaggggatcctccagggagccgccccacagggcgggaagccagaacaggatgtacagccccgccagcagggcgggtttgttccggcagaagtaaaagatcagcatcagaatgacgccgttgtagttgtagtcaaagcttccgaaggccagcaccagaacccccagcacaaagagccaccagcgccgggtggtcagcccccacatggccagcaggctgaggaagagggtgaagaagatgttccagttggtcaggttgcccaggatgtcgtcggcgttgaaggcgagaatccagaagggctgggacaccacggcgaaaatcgccagccgccccaggtagcgcctgatgtcgtgggtgtagagcaggcccaccgtcatacagtagcagaacagggggaaggccagccggccgatccaccggaatatgggcgtctccgggaagaaggccccgccaatgtgatccagcagcatggcggcaatggcgaccagcttgagcaggtcggtgtccaggttggtgcgcagctttctctcttgggtttccatgatctcattcctccggtatttcaactgagtctgccgtcagggggaatccctgacggcttccaccggtggaagcgggcctcaggcctcgcttttggtcttggccgcggcttttttcgccgtcggtttctttgccgccgtcttcgcggccggctttttggcggcggtctttttggccgccgccttttgggcgggcttcttctcctcctcgggaggggcgccctctgccgggctctccgcggaggcggcctttttcttgtagccccgctgatcctcgggcaggaagttggggcactccgggttgatgcagaagggcttcttgaacccccggcccgacttcttgaacagggtgtggccgcactcggggcaggtctccttcaccggcacgtcccaggtcatgaagtcgcaccgcttggcctcgtccttgctggagttgttctcgcagccgtagtaggcgtatccccgcttggaggtctttttgaggatcttgccgccgcacttggggcacttgccgggcatctcgatgacgatgggctgggtgtggtcgcactccggccagccggggcaggccaggaagcggccgaaccggccggacttgtacaccagattgcgcccgcacttggggcagatcacgtcggacacctcgtcgggtaccttgatgcgctcgccgtccagatccgcctcggccttctggagctcctgctcaaagtcgccgtagaagtcgcccagcaggctcttccagtccaccttgccggtctccacctcgtccagccgctcctccatagtggcggtgaaggcggtatccacaatgtcggtgaatttgtccttcatcaggccggtgaccacctcccccaggggggtggggcggaggttcttgccctccttcaccacatactcccggtccaggatggtggagatggtgggggcgtaggtggaggggcggccgatgcccttctcctccagggccttgatcagcgtggcctcggtgtagcggctggggggctgggtgaagtgctggtcgggcttgagggcctccagcttcagggcctccccctccttcagatcgggcaggggggactggaacgcctcctcctcctcgtccttcccctccacgtacacggcggtgtagccggagaacttgagggccgagtgggtggcccggaaggtgtatcccgcggaggtcacctcgatggacacgctgtcgtacacggcggaggccatctggcaggccaggaagcggctccagatgagcttgtagagcttatactgctcggcggtgagggacttcttgatgtcctccggggtcaggttcacgttggagggccggatggcctcgtgggcgtcctgggcgccggatttggtcttgtagacccgggccttgccggggtagtagtccgcgccgtagcgggcgaggatgaagtccttcgcggcggcggtggcctcgtcggacaggcggagggagtcggtacgcatataggtgatgagacccacggtgccctccccctcgatgtccacgccctcatagagctgctgggcgatggacatggtccgccggggcgtcatgttgagcttgcggctggcctcctgctggagggtggaggtgatgaaggggggcgcggggttgcgctgcttgtcctgccgcttgacgccggtgacggcgaagggggcgttcttcaccgcctccatgacggcgttgacctccgcctcgctgttcagctccaccttcttctcccggccgtagaagctggccttgaactgccccaggttgggggcgatgcgggagagatcagcgtccagggaccagtactcctgggggacgaaggccttgatgtcggcctcccgctcgcacaccagccgggtggccaccgactgcacccgcccggcggacaggccccggcggatcttcttccacagcaggggggagatctgatagcccacgatgcggtccagcacccggcgcgcctgctgggcgttcaccagatccatatcgatggcccgggggtgggcgatggagtcgttgaccaccttcttggtgatctcgttgaaggtcacccggtaggtcttgtcgtccgggatgcccagcatctccttcaggtgccaggagatggcctcgccctcccggtcggggtcggtggcgaggaacactttctcactcttcttggcggattttttcagctcgtcaatgacctcttccttgcccttgatgggctggtagttcagttcaaagccgtgctccacgtccacgcccagcttgctcttgggcaggtcgcgcacatggcccatggaggccttcacctcatagcccgggcccagatatttgccgatggtcttggccttcgccggagactcgacgatcaccaaattcgattttgccacagcatagtactccttacatacttagtcgtcaaagcggacggcagcggtaaaccgcttgccgggaagctcattcagatagccctgagcctgcagcagggtcagggcagtgttcacccgccgggcgggaatctcggtgcggcccacgatctcgtcgggcaccagggcgcggccgctcagcagggcgaagatggcccgctgttcgtcccccatggcctccagctcactccgggggcgcagagggaggggattcctctccgccggacggggcaccggctccggcgccggctcggccgccgcctccagccgcgcctccgccccctcccgggacagcgaaggggcctgccgcaccttatggggaaagcgtgtcacatattccaccagaatatcctgggccgagcggatcagcttggcctcgccccgggcgatcaggccgttggtgcccgcgctcatgggcgcgtccgccgggccggggacggcgaatacctcccggttctggtccagggccagccgggcggtgatcagcgtgccgctgtgctcggcggcctccaccgccgccacgcccgcggacaggccgctgaggatgcggttgcggatggggaagcgccacccctccggcggggtgccgggcgggttttccgacaggatggcccccgcggcggccacgtcctcgtagagtccctggttgcgccgggggtagaccacgtccaccccgccggccagcaccgacaccgccgggccgccgccctggagggcccccttgagggcggccgcgtcgatgccctgggccaggccggagagcaccagcgcccccgaccgggccagctccaggcccagccgccccgccatggccacgccgtagggggtacactcccgggaccccacgatggcgacggccagctcctcgtcaaagcggaagagccgccccttcacatagagcaccaggggaaagtcgtggagctggagcagacgctccgggtaggccgcgtcctggtaggtcagcagggtgacgcccagccggtcgcagtcgcccaggatgcgctccgcccgctccagggacttgtccgccagggagcggcaaagcctttcactcaacgaaagcagttcgtactccccggggtcggcgaagtaggccgcctctgcggtgccgaaccggcgcaccagcgccgcggccgtctcgggccggaggccctcccgggtggtgagccacagcagataggttaacgcagccacgggattgcctccttccggttgttgtcttgttctgtgccgcgccagcgcgcggtcccaccggagtggggccgtccgctggggcggcctggctcagcgccagccctcccagagcaccacagacgccgccacggcggcgttgagggactcgcagcggtcccgcatggggattttcaaagtcgcccggcaggcgtccagcaccggctgggacaccccccgcccctcgctgccgatgaccacggcggcgctgcccaggggaacggagcggatgtcctccgtgtcgtcccgcagggcggcggcgtacagggagacggccgaccgggccagcaggccggtcagatcctccagcgtcccctcccacaccggcaggcggaagcaggcccccatggtggcgcgcaccgtcttgggggcaaagggctcggcgcagccgggcagcaggaacagccccgccgccccgaaggcgtcggcggtgcgccagacggtgcccacgttgccggggtcctgcaccccgtccagcaccagcaggcggccctccggcagcgtctccggcggagcggtgtccggcgtccggcacacggccagcatgccctggggtgtctccacggtggacaccgcccgcagcagcgcctccggcacctccaccacccgcaccccggcgggcagctccgccgggggggcggttccctccgccaccgccagcagctccggcggcggcccccagcgcagggcctcccccaccagcttggtcccttcgcagaggaataccccctgggcccggcgggtctttttctccgcccccagcctgcgcaggcgggtgatcagcggattttgccggctggtgatgcgctccatggcggtcctccttacaagtcctggagatggttgatgtcctccgtgcggcccagggccaccaccgcatcgcccggctcaataacatagctggcgccgggggccacgttcagcgccccgtccttgcccctgcgcacggcgatgatgttgaccttgtaacgggcccgcacatccagattttgaatcgtttcgtagtgccactccttgggcacggcggtctccacgatgccgaaatcctcgctcagctcaatgaagttgagcacgttggagctggagagcccctgggccagcttgacccccatctcgtgctcggggaataccacccggtccgccccgatcttctccagcaccttgcggtggacgtggctctgggccttgcagatgacccgcttgaccccaatctccttcagattaagcgtgataagggcggagtttccgatatcgtctcccaccgccaccacggcgcagtcgtagttgcgcacgcccagggcccgcagaaccgaggggtccctggcgtcgccggtgacggcgtgggtgaccttttcggccaccctctgcacgtgatcctcccgctcgtccactgccagcacctcatggcccagggagctgagctccgtggccacggcgctgccaaaccggcccaggccgatgacaacaaaggttttcataacgtggaaaacacttccttttctcctgatgcggcgcttcagccgatcatgacgttcatctcagggtatttgatcttggccggatgcctgtttccggtgataaaggcgatggagaaggacaggatgcccacacggcccatatacatcagcaggatcagcagcccctgggagaagggggtgagggtgggggtgatcccggtggtcaggcccaccgtgcccatggcggaggccacctcaaaggcgctgtccaggtagggcagatcctccaccgtggacaccaccatggagctgaacacaaagacaaacagcaccaccagcgccagagtcatggcattgagcacccggcggtagtggatcgcccggccgcggaaggtgacctgctcccggcccatgaggccggagcgcagggccagcagcagcacgcccaccgtggcggtcttgaggccgccggcggtagagccggaggagccgccgatgagcatcagcacgcaggacatggccttgctggtgtcgctgaggccgccctggccgatggagtcgaagccggcggtgcgcagggtgacggactggaacagggcgttgagtcccttctgccagaggggcatgtcccccagggtggcggggttgtcaaactcctccatcaggaagaacagggcgccccccacgatcagcacagcggtgatgaggagcaccatcttgctgtagaccgacagcctgctccagcaccgcttgtccacaatgtcctcccacacgaagaagcccaggccgcccactacgatgagggcggcggtggtgcccagcatcagggggttgtcgttgtagccggccaggctgctgaaggcaccgaagcgccctcccagcagatcaaagcccgcgttgcagaaggaggagactgcgtggaacacggcgtgccaagtgcccttgaggaagccgaactccgggatgaggcacaccgacatgagcaccgcccccgccgtctccatggcgaaggtgccgatgagggcgtggcgcaccacccgcaccaccccgtccatgtcgttgaggttgagggtggacaccatgataagccgctccgacaggccaatacgccggtggagggcgaaggagacgagggtgatgaccgtcatgaagcccagaccgcccaactggatcatggtcaggatgaccgcctgaccgaacagcgtccactgggtccacgtgtccaccaggatcaggccggtgacgcaggtggaggaggtggcggtgaacagtccggtgaagaacccggcgctctgtccgtcccgggaggcgatgggcagggtcagcagcagcgccccgatcagaataatcgccgcgaaggagcccgccacgatccgggtggcgttgaggctccggctgcggataaagctgtcccgcagccagagcgcgcatttcttgatcaaagccttggcctccttaagggtgggatggaaacgattttgacgcagaaaagcatgccgaaggaaggattcccttcggcatgctcattcagtccggcgaattccagccggggatgggagcagcgggggtatgaaacgcccggtcagcacgcagatattcacttcccaggcgcttctccatggctctcctcatacccccttgcacttgctcccgcttcccaggacagaccggctcaatacagcttggcgcccgccggaatgtggtcgtccaccatcaggcagtggagcttctccacgccctcctcgtggtgtaccgcggagatgatcatgccgcaggagtcaatgcccatcatcttgcggggcggcaggttggtaatggcgatgagggtcttgcccaccagctcctccggctcataggtgtcgtggatgccgctcaggatcacacggtcctcgccggtgccgtcatccagaacgaacttcagcagcttcttgctcttgggcacggcggtgcactccttgaccttcacggcccggaagtcggacttggcaaaggtctcgaagtccacgaactcctggaacaggggctcaatctccaccttggagaagtccaccgggccctgctcggcggcggggacagcgcagttggttccagccgcggcgcgcttggcggactcaggcttgtccaggggcttcatggtggggaagaggatcacgtcgcggatggagtcggagtcggtgagcagcatcacgcagcggtcgatgccgatacccatgccgcccgtggggggcaggccgtactccagggcgttgatgaaatcctcgtccatcatgccggcctcgtcgttgcccatctcacgcagggccagctcgtgctcgaagcggccgcgctggtcgatgggatcgttgagctcggagaaggcgttggcaaactcacagtggttgataaacagctcgaagcgctcggtgaggcggggatccttgggggagcgcttggtcagcggggacacctccaccggatacatggtgatgaaggtgggctggatcagcttctcctccacccgctggtcaaaggcctcgtacagggcggtgccccaggtgcgctcgcagccctccagatcgatgcccttggcctcggcggccttgcaggcctcctcgtcgtcggagatggcctcaaagtccacgcccacatactcccggacggcatcgatcatggtcatgcgcttccagccgggagtcaggtcaatctcgttgcccagccaagtcacacgataggagcccaggatctccttggcagcggtggagagaaccccctcggcaatgtccatcatgtcgtggaagtcggcataggcctcatagagctcgatggtggtgaactccgggttgtgcttgggatccatgccctcgttgcggaagatgcggccgatctcatacacccgctcaaagccgcccacagtgagccgcttcaggttcagctcggtggcgatgcgcatatacatgtcgatgtccagggtgttgtggtgggtgatgaagggccgggcggtggcgccaccggagatggtgttgaggacaggggtctccacctccaggtagtcccgctcgtccagataccggcgcatatgcttgatgaaggcggtgcggatacggaaggtacggcgcacgtcctcgttcatgatcagatccacatagcgctggcggtagcgcatctccttgtcggtcaggccgtggaatttctcgggcagaggctggagggacttggagagaagcgtcaccttgtgggccttgacggagatctcgccccgcttggtcttgaagacctcgccttccacgcccacgatgtcgccgatgtcggtctttttgaacttggcgaaggcctcctcgcccagctcgtccacgcggacgtagagctggatgcggcccttgccgtcctgcagatcgcagaacacggccttgcccatgccccgcttggacatgatgcggccggccacggaggtcatagcgccctccagggcctcaaagccctccttaatgtcggcggagtggtgcttcaccacaaatttggtgatctggaaggggtcctggcccgcatcctgcagctccttgagcttggcgcggcggatcaggcgctgttcggacagggacggctgctcctcgggctggttgacgcttctctcttctgtgctcatgactctgctccttacttttgaatctctaaaatacggtacctcagtacgccggcgggggcctccacctgaacctcgtcacccactgcgttgcccagcagggccttgccgaagggggagtcctcggagatacggccgttcatggggtcggcctcctgggagcccaccacctggtagctctcctcctcctcgaactccagatccagtaccttgaccttggagcccaggcggacggaattggggtcggtctcatgctcctcgatgaccacatagttggccaggatgttctccacctccgcgatgcgggagtagagcttgccctgctcgttcttggcctcgtcgtactcactgttctcggacaggtcgccgaaggagcgggcctccttgatctggtcggcgacctccttctcccggacggtcttcagatagttgagctcctgcttgagctcctccaagcgctccgcgctcagcttaaattctttcgccattgccgtatgcgcacacctttcttttttgcttcttccttatcggtcaaaaggcctcaaccaggcctcttctgaaatctcaacagaaacattacgccacgttaatacgatattataggtagtttcccaccttctgtcaagtcaattatttcccatcatgtggcatgaatccggatctgtccctctgtcaggcggccgcactcccacaacagggacagcagcggaaggggggccaggtccggcggcagcccgccctcctccggtgtggggcgcaggccggccagcccgggcacggggccgtacagccggagcaccgtccccctctcctccccgcccggaccaaaggccagggtcacgtcgggggccgccccgccgggccgcagcaccgccgcgccatactcctcccgcagccacgccgccagttcctccccctcgccgggcacatccaccaccagatggcgcacctggggacacaggcgctccgccgcagcaaacagcggccggctcacccgggggccggacagggccacagtggcccgcacccgcagtatgcccgcccgccggagcgcggccagggccagggggacggcgatagcctggcagaagggctccgggtccacactccgcagcccctgtccctccagcgcgggccagtcgggaaaatcctccgccgtcagcgcccgccgtactcctgcacggtacagggccgccgccccctgctccgcccgcctcttccgcctgtcctcccgcagaccggggcggaccggcaccgacacccgcagacagcgcaggcccagcacccgctcctccgtcaccaccgggcggcggccccgccgctcctccagcgccacaattcccaccaaccccatcacctcgggaacaggatatgcgccggggcccggtttatgcgggcggaggatataggaagcgccgggggttagtgcccccggcgcttctccttctttttctcctggcggaggcggaacctgcgctcctcctccgccgcgtccctttggcgatgccgctgcgcccgttccgccctgcgcgcctcccgctggagctggagagcctgctgggccttcgtgccggcgccggttttctctggacggttccgcgcctgccgccgagcccgcttgggattctcccggccagatggacgccggggcgcctctaccgctggactaaagtccaggccccgccacgccgacaggagccactgccaaacctccccgtcctttggctcggcgccgaaggtatggcggcacacctccaggcgcccctccgcctcccgctcgtacacgcccacccagaaggggtcggcaaaccagaccgtcagcctcgcatagccgcattccatatgaagttgtcctccttaaatataggtcttgcgcggagcgcggacaaccaaggaggcaggttactgacggtccgggggcgggacgctcccccggaccgcgcccggactaccaaccgggccgtgtttttcgttccgccctctgattatcactccggttccgccgcttgtcaacccccgcgcctcacctttcctttacgatatcttacaaagagtttagcttgttttacaccacgctgatagcgcactccccaatctatccgctatcatggcagcgtaccgagcgtatcaaaataactttggaggaatcagaatgaattggaagcgtcccctggccctgtccacggccgccctgacgctgggcacggccctggctgcctgcggcaatcccacggccgccgcgcccgatcccacccccacgcctgccgccgaggttcagtccctctccaccaccggctccaccgtcaaagcccccaaatacgtgtttctcttcattggcgacggcatgagctatccccagatccagtccacatccgatttcctgggtgcgctgaacgacgccgactatcggcaggcccagcccagcctggacgacaacggcggagccattctggacggtcccgagtacctcaacttcatgaactttgaggccgccggctccgccgtgacttatgactccaactcctttgcccccgactccgcctccaccgccacctccatctccaccggctacaagacctactccggctccatcaacgtggacgaaaccggcaccatttcctacgaaaccattgccgaacagctccacgcccagaagggctattcggtgggcgtcattacctccgtcaacctcaaccatgccacccctgccgccttctatgcccaccaggccagccgcaatgactactacgacatcggcctggagctcatcgactccggctttgagtacttcgccggcggcggcctgctcaagcccaccggcgccgagggagatcaggccgatctgtacgccctggcggaaaaggcgggctatcatgtggtcaagacccaggctgaggccgagcaggtcaccggcggcccggtggtaatcatcgacgagcacctggccgacagcgacgccatggcctacgagatcgaccgcaccgacgacatgtgggccctggccgactacgtggaaaagggaattgaggtgctctcccaggacaaggacggcttctttatgacgtgcgagggcggcaagatcgactgggcctgccacgccaacgacgccgcctccaccatccacgacacgcaggccctggccgatgcggtacaggtggccatcgacttcgccaaggagcacgccgatgagaccctgatcctggtcaccggcgaccacgaaaccggcggcctcaccatcggctttgccggcaccgactacgacacctatctggatctgctggagagccagaagatctcctacgccaagttcgacagcgactacgtgtccaggtacaaggaggacaagacctcctttgaggatgtcctgaaggatgtggaggcgctcttcggcctcaagccccagggcgaggagggcgataagctggtgctcaccgactacgagctggaacagctccgcgccgcctacgaaaagagcgtcaacggcaccgctgccagccagtacgagcaggaggaatacgtgctctacggcacctacgagcctctgagcgtcaccctcacccacatcatcaacaacaagtccggcatctccttcacctcttacagccacaccggcctgcccgtggccgtgctggcccacggtgttaacgccgggcagttcaacggctactacgacaatactcagatctatcacaagctggccggcatgctcggcatagcctaacccctgctttcccacttccatacagccgaggcggatggggtctcccgaccccatccgcctcggcgcagaaaggacttatccatctatgcgttttctacgtgaccccgcccagcgccgctattatgtccccgtcgtgctctgcctggcgctgaccgccctgctgctcctcctccccaccgggtatgaaggggccgtccagtaccaggaggccgaccgctgcgcggcccgggtgctggcggtggacgactccaccatcgtggacaccgggctcgtccgctccggtgagcagcgctgcactctggagctgctgggcggccggtttcagggacgaaccgccaccggcatcaacatgctcaacggctccctggagcaggacaagctgttcgcccccggtgacaaggccatggtggtggtcagctgccagggggacgagattctctccgtcaccatgaccgaccactaccgcatcggcaaggaggctctgctggccgccgtcttcgccgtgttcctgatcctcttcgccgggcgtaccggcgtgcgggccatcgtctccttcgtgctgacggtgctgatgctgtggaaggttctggtgcccctctacctcaagggctggaaccccatcctggtcggcctggcggttactctggccctcaccctgctgatcatcgccctggtctacggcttcgagcggcggtgcgccgccgccgtgtcgggtgcgttcctgggtatactggtcacatgtgtgctgggcattgtgtttaccgacctgtttcagatccacggggccgttatgtcctactcggagagtctgctctactccgggtatcaggatctcaacctgacccagatctttatggcggcgatcttcatcggctcctccggcgcggtgatggatctggcggtggatatcacatctgcggtcaacgaggtagtgaaaaagcgccctgatatctcccgctgggaggcggtacgctccggtatgaatgtggggcgggcggccatgggcactatgacaaccaccctcctgctggcctactccggcggctacgtggccctgctcatggtctttatggcccagggcactcccctctataacattctcaactacaagtatgtcgcctcagaaatcatacacaccatcgtgggttccttcggtctggtgactgtggctcccctcaccgccctgaccagcggctttctgctggccgggcagagagagcccagcctccccacgccgcctgtccgccgggcggcagaggggcaaagcgctccgcaatcgtattaagatactgtcgataaaccctcctgttaaacattcggagggagggatcgtgtgaaaaaccgccccgcagggcgattcggagcacgaccgccgcttgctgcggctcctgatccggagatgaaccatccgggttccctttcacgttggatctaacgacttttgccaaagactgaaccccaccggcttcgccggtggggttttatcccttccctaaaagcgaatgttggcgcgggtcatgcccaagctggtctccagctcaccgatcgtcattctgctcgcctccttgtctccacggtagggtatcaagtgggtttacagtcaagacttttttaccggattttcagcaattccagcgcggcggccaattgagtatcctccgctccggtgttgtatacctccgcgtccagggtcaggccggtgccgataagggaggcgccgcttccggtgaagtaggcgccggtggagatggccacggcgccgccgtggggcagagggaaggtctgctgggagtagcccttgccgctggtgggctcccctacgatcaccgccgcgccctgctcctggagctcggcggcgaaaaactcggcggcggagtaggtgtcggcgttgaccagcaccgccatgggcagttccacacagtccgcgtcggagttggtgatctcctcatggcccgcccggtcgcggctgatgaagatggggccctcgggcagcaggaagtccagcatgtcggtgagctggctcaggtagccgccgccgttgttccgcatgtcaaagaccagcgcctccgccccctgctcccggagctgggtgacggcctcctccagccgctgggcgctgtggtcgtagaagttgagcaggcgcacatagcccacctttccctccagcatccggctctccaccgggtcggtctccagctcggcccgctccacctccacggtgcgggccgccccgtcctcccccagcatctccagggtgacggtggtgcccgcctccccctggatgagattcgcgccctcatagcgggactctcccgccagggagacgccgtctacagcggtgatgacctccccggcttccaacccagccgcctcggcagggcctccggtctccactccgaggatatagagtccctcctcccgtgtgtagttgacggtaatcccaacccccacatactggttggtgcggcgctggttctgggcctccagctcctccgccgtcaggtagtagctccagcggtcgcccaggcgggacaccatgccctccagggcggcgtccaccacctctgtctcgtcatattcccccacaaagagggtgttgaccagccgcagcccctccaccagggaacgcccgccctcccccatccaggcacggacggccaggagtccgcagcccagcacggcagcggcggtgagtgcaatggccagcagaagctgggccagggaaaaacgtttctttcgcacgggatcagatcctttccagaaaaaccagcgcgggcggaggccgatgcctccgcccgcctctgggccttgcccgcgcacagcgggcggaatttccacagcaacgcggccctgccgctatccggacattaccaagggtgggtcaggctcaggctggggaacttgctctccgggtccacacgggtgtagttgtcccgcacctccaggtgcaggtggttgcccgtggagctgccggtggtgcccacatagccgatagtctggccctgggacaccatctgcccctcgctcaccgcccgggagctcatgtgggcgtagagggtggagttaccgttgccgtggtcgatgaccacgtaattgccgtaggagtagtggtaggcggaggtgaccacctgtccgctcttgcaggcctgaatgggggtgccgccgggggcggggatgtcgatgccggtatggctgtgggccttgccggtgatggggtgaatgcggtagccgaacagagaggtcagccggtagtagccgggcagcggccacaggtagttggtctccgagtcgatggtgacattgttttgccggcgctcctcctccagttgcttctgcttccgggcgatctccgcctggatctccgccgcgccctccatctcgtcgtccagttggcggttgagctccgccgcgtcggcattgatctggtccagcagcttctgggcctccgccaccttggcctgctgctccgccttcttggcctcctgctggtccttggccgcctgctcctccgcgcgggcgctctccagctccgcctgaagccgctccagctcctgccgggccgcggtcagctcctccatgacctggttgtcgtagtccatcaccgcgtcaatgtccgccaggcggtccagcatgtcggagaagttctcggcgttgaagaggatggaccaataggataccgtcccctcctcctccatggcgcgcacccgctcgcagaacagctcatactgggcctgctctttggcctccgcctccctgcgctccgcctctttctgggcgatttcctggtcatagtaggagatctgcgcgttgatgctgtccagctcggcattgattgcctccaactgctgctgtaggagctgccgcctctgctgggcggcagcctggtcctccttcacgtcggccagctggttcttcaactcctgctgcttgacctggctctcccgctgctcctccttcagcgcgtcgatctcgctctgcgtcaccgcgcccacgccgccggcgatcatgctgatcatgggcagcagcagcaggagggccatcaccacggccagcccggccacaaacacccggcgccactcgattttctgtttctggggtctctttttctgactctgcttctttgccacgttgccgctccttttatgtccgttccattaccaattataggcccgaatgaagggaagattgggataatatgcctcggggtccgtccgctggccgttccgccgcacctcatagtggaggtgggggcccgacgtattgccggtgtcgcccacagcgccgatggtctgcccctgggacaccatctgcccctcgctcaccgcccgcgaggacatgtgggcgtagagggtggtggtgccgtccccgtggtcgatgaccacgaagttgccgtaggaccagttggcgccggcgccatactccgacatgatgacctgtccgcccctggccgcgtagatggggacgccggtggaggcggccacgtcaatgccggtgtggctgtttggcacgtgatccaccgggtgcatccggtagccgaaggccgaggtcagcttcaaattggacgcaggcaggggccacagccagccgtcgccggtaggcgggagctggacgttgttctgcttccgctgctcctccagctccttctgcttccgggcgatgtccgccccgatggcggcccactccgcgttctctgtgtccaactgccggttgacctccgccacatcggcgttgatctggtccagcagcttctgggcctgcgccaccttggcctgctgctccgccctcttggcctcctgctgctccctggccgcctgctcctccgcgcgggcgctctccagctccgcctgaagccgctccagctcctgccgggccgcggtcagctcctccatgacctggttgtcgtagtccatcaccgcgtccacatcggccagacggtccagcaggtcggagaagtcctcggcgttaaagaggatggaccagtaggacaccgtcccctcctcctccatggcgcgcacccgctcgcagaaccgctcatactgggcctgctctttggcctccgcctccctgcgctccgcctctttctgggcgatctccccgtcatagtaggagatctgcgcgttgatgctgtccagctcggcattgattgcctctaactgctgctgtaggatctgccgcttctgccgggcggccgcctggtcctctttcacgtcggctagttgctccttcagctcctcctgccgggcctggctctccgcctgctcggccttcagcgcgtcgatctcgctctgggaggccgccctcacctgccgggccagcccgccccaggcgggaaccagcagcgcggccgtcagcagggcgcatgccgcccgccgaagggatctgtcaaacgccatggaagcctccttttgccgctgccgttatacctgcagaaacttgcggatggccagcaccgagccgcccgcgccgatgacgaagccggtgaggacgaacacgcccagcacccgtaaagccatgggctggaagggcagcacggtgatcagggagatggtgtccgagccgctgatggcgctgcccaccagcacatagatgccccactggaggaagaaggccgccaccgcacccaccagccccaggatcaggccctcaaagacgaagggccagcggacaaaggcgttggtggcgccgcacatcttcatgatggcgatctcctcccgccggttgaaggtggccagcttgatggtgttggcgataataaacaggctcaccgccaacaggatcaccaccaggatcacggccaccgccccggcgatgttgcggatgacggtgaagccctcggcgatctcgggggctgatttagtcttggccacgccggttacctcttttaccgcgttctctgtctcagtcagcttgctgatatcgtccagatagacgtggaaccggtcccggtacacatcggagggcaggccgtcaaacagctcgttgccctcataatcggcctcaaactcctcttgggcctgctccttggtcatgaattccgcccgggccacgttgggtaccgcctcgatgtcgtcctggagggctttggcctcctcctgggtgaggctctcgtcgatgtacgccgtgaattggttctcggcctccagatcgctgaacatgttctccgcattcaccgccaccagggtaaaggagcccatgatgagcaggcagcagataatcatgcaaaccgcggcgaaggacataaagccgtgagtgaagatgctgtggaagccctcggagaggaaatagccgaaatcatatcgttgtctcattgttgtaatacccgcccgtctcgtcgctgatgatcctgccgttctcaatggccaccacccgcttggagaagcggttgaccagttccttcgcgtgggtgaccaccagcacggtggtacccagctcgttgatgcgctccagcagcatcatgatctccagggagcgcatggggtccagattgcccgtcggctcgtcggcgataatcatctgggggttgttcaccagggcgcgggcgatggccacccgctgctgctcgccgccggagagctggttgggcttgcggtcccccttctggtccaggcccaccagctccagtacgtagggcacacgcttgcggatctcccggggggaggcccccaccgcccgcatggcaaaggtcaggttctcccgcaccgtctttttctcaatgagccggaaatcctggaagatgacccccagggtgcgccgcatgtagggcacctgccggggccggatgttgttcagattgtagccgttgaccatcagccgcccgccggtgggcgcgatttcggcggtgatgagcttcagaatcgtagactttccggagccggaagggcccaccagaaagacaaattccccgtcatcgatgcgcaggttgacccccttcagggcctttgtcccgttgtcgtaggacttttgaatgtcaataagccgtatcacgctcggttacctcatttatcgtattcgaaagaaatgcccactgccagcagggacgccgtctccggcgcccctgctggcagtgcactcagttgtcgatgccccgggagatcaggtacttcttgaccatcagcgccaccttgaaggtgatggcgtcgtcaaactcccgcagatccagtccggtaagcttcttgatcttctccaggcggtacaccagggtgttccggtggacaaagagcttccgggccgtctcggatacgttcaggttgttctcaaagaacttgttgatggtgaacagggtctcctggtccagtgcgtcgatggggttcttcttaaatacctcttgaaggaacatctcgcacagggtggtgggcaactggtagatcagccggccgatacccagattctcgtaattgatgatgctcttctccgtgtcgaacacccggcccacgtcgatggcgatccccgcctccttgtaggcccgggccaactcccggatgtggcccacgatggtgccgatgccgatgaccacccgcacatggagctcctcggtgatcttctcctcgatctgcttggcgatcttatagagctcccgtggctcggccccctcagagagctgcttgatgagggccacgtcagtctcgctgatcgagaggacgaagtccacctgcttgtcggggaacagggtatgcaccacgtcaatgagggcgggatcgctggtctccacctggcggatcaggaacaccgcccggggcgcctcggagacaaagtgcagctccttggcgcggacatagatgtcccccagcagaatgttgtcggagatgatgttcttgacaaaggtggccttgtcgtgcttctcctcatagtaggtcttggcgccgttcagcgccaccgtggccatggcgcagagcatctgcgcctcggggtcctcacccttgacaaaggcggcatagtcgaactgggccccccagccggccagggccttgaaggtgcgcccgtcaaagcggaccgcgtctccctcgcccctgttgaccacctccacggcgcccggccagtgctccccgatgcagctcagctcattgcaggccaccaccgttccctcagaatcgatcacgccgatggctctctccgtgctgtccttcatctgtaagacaacgctctgaaaaatcctgctggacatggtgatagcctccttattttgattcccccgcagggggacaaaccgctctctcgtccatttcctttctattataccgggtctttttgcccttttcaataggttttgcaaaattttttgttgaaattgccgaaagctgacaggaagcacagaggccgtgggctgggagacgaaggcagggcgcagacgaaaccgcagcgctaagccaaagcgctggcatgcccggctgtgccgggcaagttggccgtgagcgttccccgctcgggccgcccctacgcctgccgcagagcggccacctcctccgcagacagaggccgccactcccccctttccaggaccgggtccagcatgagcggccccatggtcagccgtttgaggtacaccaccggcttcccccgggccgccagcatgcgcttgatctggtggtacttgccctcgtgtagggtaacgagggcggtgtccggctgctccagcacctccagccccgcaggcaggcaggccagcccgtcttccagcatcatccctgcggcaaaggccgccgcgtccgccccatccagttccccgtccacccggacgaagtaggtcttgtccacgtggtgccggggggccagcaggcggtgggccagggggccgtcattggtgagcaggagcaggccctcggtgtccttgtccagccgtcccgccgggaagagccccacccggcgcagatgctggggcagcagctccagcacggtgggctggcgggggtcctccgtcgcggacaccagccccgccggcttgtggagcatcaggtaaaccagccgctccccggaaaccgtttcgccgtccacctcaaagcgggccgcggggtcgtatttcccgtccgccgcctgggccgtcacgccgtccacggccacccggccggcccgcaccagctcccgcgcctcttttcgggaccaccggcctgtattggccaaaattttatccaaccgctccataggctcctcctgtggctcgtccttttttcaacattttagcatacaacggtggaaaagaacataccaatcatcacgaccacttttcggaagggagcgttgcgctgtgttcatcatcaccgccaaggtccgcaagggccgaattgtagccgtcgcggcggctgccgccgtggtctgcggcgtactggtggcggccgccgggctgctgggggggcggggcgcggcggcctccgctgcggtcagccccaagggagtccgcaccaacgaggaccggatcgcctatctggagagttacggctggtcggtctccagcgaccccatcgccgtggaggagctgatcatccccgagcagttcgacgagacctacagccagtacctggaactccaggccagccagggcttcgatctgaccgactactgcggcaagcgcgtcaagcggtacacctatgagatcaccaactaccccaccggtgagagcggcatccaggccggcctgctcgtctacaagagcacggtcatcggcggcgatgtgctctccgcccagctcgggggcttcatccacgggctggagatgcccgcctgaatgcaaaacgcggcgctttcgcgccgcgtttttccgtattcaataccgcagacttttgcaggcccggtagaggaatatcagcaggaggatcccgcccacaacagacgcgatggacgcggggacgattaccaccatcgccagtatgttgaccagcgggatgagactcaggatagagcagaccaccaccagggccgtgcagcccccatagaacttccacgcaaaccgtccccgggctgccgtgcccaggtcgcctttgacctcaagcaggccggcagtggtagtacaaaccaggtagatcaccaccagactcagaatcgaagtgactatattcagcaccccgataaaaaccgcgagtacgctcagcaccagaatgccgatctccacatagaaggcggtgcggtagccctcgtcggccccggcggcctcgtgaaggccaaccaggaacaggacgatacccacaatggcggcaatccaccccaccaaagggatgatcaccaggatgctgaggatctgcccgtagaacatcttttccagtccgctgcccgcaatggtatcgttactcactgttcttcctccttccgttccactaagtggacattcagatggttgtaggtcatctcaatgccgttctggtcaaaagcctccttaacctgctccaacaggtcgtagtacagcgtccagtaatcccccgtggcgcaccacacccggaccacatactcaatgctgctgtcccggtaggcgttgacccgcacaaagggctccggctcggccagggccatggggtgcgcggccacgactgcccgcagaacgccggtcacctgctgaagcgggctgtcataagaggcgttgaaggtgagatctactctcctccgctcttccgtactgtagttgatgatcttttccccggaaatctgtccgttgggcacggagatcaccttgttgtccaccgtgcacagcttagtataggccagcccgacctccatcaccgtaccggagatgccgccggcctccacgtagtcccccgccttgaagggcttggagagcagcacctggatgccgccggccaggttggacagagtgccctggatggccagagacaccgccagtccaatgacgctgagcaccgccaccaggctggtcatgggcactcccacgtagtccagaacgatacacagggtaatcatccacaaaatcacccgcagtgccgcatggatgaaggtatgcaggctccgctccagctccagacggaggaaagcccggtcggtcagccggagaaccagcttcatgaccacaaggcagcctgccagaaggagcagcagggtgatgagcttctccagattcagccctttcagaaagtcggtcaccgtctgtaaggtctcctctgcctcgtccggggtgacggctcccaggttggtcagtgtaatctgcatgtctgatacgccccctcactctcttttcctctgttgtatcataaattcaggggcctgtccagtagacaggccccttcagcctgtcgaaaaatcgttccgacaggctgcggaacgttttgtaccttcaaacagatacaaaacgtggtttgagccaacgcgaatggcccagatcggccttcttaatagctgatacatcggtttgctaacggagaaacggcgtagccaaagctacgccgtttcccgaaaacaatcttatgctgtcttatgagtgccggcccagaggccagctctttctaacggagtggtaattactcctcgatgtcgatgacgacgccggaacccacggtacggccaccctcacggatagcgaaacgcaggcccttctcgatggcgatgggggtgatcagctccaccttcatgtcaacgttatcgccgggcatgcacatctcggtgccctcgggcagggtgatgacgccggtaacgtcagtggtacggaagtagaactgaggacggtagttgttaaagaagggggtgtgacggccgccctcgtccttgctcagaacgtacacctggcccacaaacttggtgtgggggtgaatggagccgggcttacacagaacctggccacgctcgatgtcggtcttggcgacgccgcgcagcagggtgccgatgttgtcgccggcctcagcaaagtccagcagcttgcggaacatctcgatgccggtgacgacggtcttcttcttctcgtcggtcaggccaacgatctcgacttcctcgttcatcttgatggtaccgcgctccacacggccggtagcgacggtgccgcggccagtgatggtgaacacgtcctcgacgggcatcaggaagggctgatccgccttacggtcaggagtggggatatagctgtcgacggcatccatcagctccttgatgcaggcgaagtcgggatcgtccacaccgccctcgcaggtcagggcgttcagagcggagcccttgatgatggggatatcgtcgccggggaactcgtacttggacagggtctcgcggacctccatctcgaccagctccagcagctcctcgtcgtccacctgatcgcacttgttcaggaacacgacgatggcgggcacgcccacctgacgggccagcaggatgtgctccttggtctgagccatggggccatcggtggcggcgataaccaggatggcgccgtccatctgagcagcaccggtgatcatgttcttgatatagtcggcgtggcctgggcagtcaacgtgggcatagtgacgggcatcggtctcgtactccacgtgggcggtgttgatggtgatgccgcgctcacgctcctcgggagccttgtcgatgctggagtaatcctcgtactgagcctggcccttcagagccagatacttggtgatagcggcggtcagagtggtcttgccgtggtcaacgtggccgatggtgccgatgttgacatggggcttggtacgctcaaatttagccttagccatttggatgttcctccttaaattctgatagtaagatggttcttatttccacaataatgcgaaaatattgtatagcattgcagaataaaatgcaatacccttgttgcgagaaatgccaaaggacagaaattaatcgtccttgcggccccgctccgcgataatcttctcggcgatgctcttggggatctccacatagctgtggggctccatggagtactggccgcggccctgggtggaagagcgcaggtcagtggcgtagccgaacatgctggccaggggcaccagggcatccacctgagtggcgccgggacggctctcctggccctgaatcatgccgcggcggctggtcagatcgccgatgacgttgcccagatactcgtcgggcacgatgacagaaaccttcatcacgggctccagcaggatggcgtctgccttgcggcaggcctccttgaacgccatggagccggcgatcttgaacgccatttcggaggagtcgacctcgtggtaggagccgaaggtcaggtggaccttcacatccacaacagggtaaccggccagaacacccgcctgcatggcgccctggataccggcgtccaccgcagggatatactccttggggataacgccgccggtaatctcgttgaggaactcatagcccttgccgggctcattgggctccacggtgatgcggacgtggccgtactggcccttaccgccagactggcgggcatacttggtatcctgctcgaccgacttcttgatggtctccttgtaggcgacctggggtgcgcccacgttggcctccaccttgaactcgcggagcagacggtcgacgatgatctccaggtggagctcgcccatgccggcgataatggtctgaccggtctcctcgtcggtccaggtacggaaggtggggtcctcttcagccagctttaccagcgccaggcccatcttctcctgaccagccttggtcttgggctcgattgccacgcggatgacagggtcagggaactccatggactccaggatgatggggtgattatcatcgcacagggtatcgccggtggtggtgttcttcaggcccacggcggcagcgatgtcgccggagaagacctcctcgatgtcctcccggtggttggcatgcatctgcaggatgcggccgatgcgctccttctggttcttggtgctgttgagcacggaggaaccggtggtgagcttgccggagtacacacggaagaaggacaggcggcccacataggggtcggtcataatcttaaaggccagggcggagaagggcgcgttgtcgtcggcgggacgctcgtcctcctcgtcggtgtcggggttcacacccttgatggccgggatgtccagcggggagggcatgaagtcgacgatggcatccagcagcttctggacgcccttgttgcggtaagaggtaccgcaggtcacgggaaccagcaggttctcgatggtgcccttgcgcagggcacggcggatcatatcctcggggatgggcttctcctccagggccagctccatgatctcatcgtcgatgtcagcacaggcgtcgatgagcttggtgcggtactcctgggccagctccagcatatcggcggggatctcctccacgcgcatgtccttgcccagctcgtcgtagtagatgtcggcatccatctccaccaggtcgatgatgcccttgaaggtatcctcggaaccgatggggagctggatgggcaccgcgttgcacttgagccggtcgtggatcatgttgagcacgttgtagaagtccgcgcccatgatgtccatcttattgacgtaaatcatgcgggggaccttgtagtggtcggcctggcgccacacggtctcagactggggctcgacgccgcccttggcgcacatgacggtcacggagccgtccagcacgcgcagggagcgctccacctccacggtgaagtccacgtggcccggagtgtcgatgatgttgatgcgggtctgggggaactggtccttggaccccttccaatagcaggtggtagccgcggaagtgatggtgatgccgcgctcctgctcctgagccatccagtccatggtggcggtgccgtcatgggtctcaccgatcttgtagttgacgccggtgtagtagaggatacgctcggtggtggtggtcttaccggcatcgatatgggccatgataccgatgtttctggtattctctaaggtaactttcctaggcatactctaactccttattaccagcgatagtgcgcgaaggccttgttggactcggccatcttgtgggtgtcctcgcgcttcttgaccgcggagccgaggttgttggcggcatccatgatctcgccggccagccgctccttcatggtcttctcgctgcgggcgcgggagtagttggtcagccaccgcagaccaagggtctgacggcgctcggggcgaacctcgatgggcacctggtaggtggcgccgcccacgcggcgggccttgacctccagggacggcatgatgttctccagagcggtggtgaacacgtccagggggtccttctcggtcttctccttgatgatgtcgaaagcaccgtagacgaccttctgggccacacccttcttgccgtccagcatgatgctgttgaccagcttggtcaccaggacggagttgtaaatcggatcgggcagaacctcccgcttgggtacgtttcctcttctgggcactttgcttccctccttcatagtatgatttcataggtactcgaaggcttttcagaaaagcccccgtgtaagacaagtgcctgcttgtccagtgccccacagaaaacgccccctattatatataggtaagcgcttccgcaaggacaactgccttgcgcgtttgcgcataaagtctcttattgggttttcagaagaatttttacggagaaaaattacttcttgccggccttgggccgcttcgcgccgtacttggaacgggcctgcatgcggttggcaacgccctgggcatccagagtgccgcggatgatgtggtaacgcacgccgggcaggtccttgacacggccgccgcggatcatgaccacagagtgctcctgcaggttgtggccgacaccggggatataggcggtgacctccatcccgttggtcagacgcacacgggcgatcttacgcagagcggagttcggcttcttgggggtggcggtacgaaccgcagtgcacacacctctcttctggggagaaggcaggtcggtcatgcggttctgcagggtgttcaggcccttctgcatggcgggagcggtggacttgtaggtcgcggcctcgcgtcccttgcggacgagctggttaaacgtaggcatggttttcctcctttcttggtttctaaagaatatattttaacgaaacggatgaaaattattccgtttcgctaaaatcagtgcagcagcgcggccaccgcgctgggcacggcgataccgcatgcggagcccagttccttcatctggggaacccgctccaccggaatctgtttttctgcgcacagggcctccaccggggcggtcaccctgggatcggcatcctctgccagaaaaacccgggcggctttcccatcattgacggcccgcttggtctgcttgacgccgaccaccttggagccctgcttgagttccgtcagcatgcggtctgcctcccatcgcttgatttgcagggccgtctggcttttctgccgcgtatccccttttggcaggcatacctgcgcgatttagaattttaccatatgcgaattctaaagtcaatcagaaaatcactagattttgcaaagctttccggcccgtttccagtcagaaatgacggcgggggcggcgccgacgatgcgccgcccccgccaggcagtgttcagaagggaccgtaaccgatctggtttgcaataatgatcaggaggaaccccgcggtaatcagacacgcgtaaattttccaagcgaacttgaaccagtggccgtagtccataccgcacagagagagctgaagcagggaagcggtgggccagaaggtgttggtgaagccgtcgccgtattggtacgccagcaccatgacctgctgattgatcccaagcacctgacccagaggctggaggatgggcatcatgaccacggccttgccggagccggaggagacgaagaagttgaacagagtgacaaaggcgtaaatgatgagcagggtgatcaccgggctcttgccctccagcaggccggacacggcgtggatgatggtgtcggtgatgttgccctcggtaagcaggacggacaccgcccggctcaggccgattaccatggtgggcgccaccacgccggccatgcccttgccgaactcggagcaggcctcggaaacgctcatgcgggagagaaccacagccacaatagccacgggcatgtagaccgcggtgatctccggcaacccccatttccaccggagggaacccaccacagagaggacaatggcggccaggaacaccacaatgatagccacccggcggccgtggaagtccaatccttcctcaaactgcatgggcgccgtctgctcctggagataattctctcccatcacgctgtacttggggtttttcttgattttaatgcaatagcgggtcaggaagaatacggcgatggcatagaaaaccaccagtccaaccgcccgcagggcgatgccggagtacatgggcaggcccaccagtgtctgggccacgccggtggtgtaggggttgaccataccgcaggtaaagcctacggcggtggagagcatgatgatggcggtgcccaccatcttgtcatagcccagggtgatgaacagagagatgataatgggatagaagggatagagggcatccaggtaaccgatgacgcccatgccggtgaagatcgtgaagaacagaagtaccattaccagaccccggcccttggcccgcttgatgagggcctgaataccggcggagaaggcaccggtcttctggatgatctggatggcaccgctgatgagcagcacggctccgatcacattggcgctctccacaaagccctggtgaagagaggtaaaaaagctcaggaaggaaaccggggtctgctccacataggtaaagctgttcggatccacatttccgtccaccctggcgtatgttccggcggggatcacataagtcatgatggttaccagcagcatcaggatcagaatgacggcgtacacatggggcatgctgaagccttttttcttttttagtgtattacccatagtggtgatacctcctcactgtgtctgccccggcccgcacacgctctcgccgggggcggggtgtcactggcccgcatgcctggtcagccagcccacggcggagttgaccaggatggcggtccccagcgcaaaggcactttcgtccagcaccatgttgggattgtgcagaggatagccctccggcgagccggcccccatgaaggcgtagaagccgggtaccagccgggtcacatgtccgaagtcttcggcgcccttcatcggcgggacgggcctgacgttctccgcccccaggatctccgcagcgaaggggacaatctcctcagagaaggcggcgtcgcacaccgtactgggggttttgagcacccgggtggtataggtgccgtgccaggcgctgacatagtggtccaggatctcggggatacgcacaagcaggtggtcgtaggcttccgggctgagagtacggaaggacaccatgatctccgccgtatccgggatgatgttggaggcccggccgccgttgagcgcgcccacggtcatggtggcgaaggcctctgggtccacctcccggggaatgagcatgttcagggccgagcatacctgggtggcgatgttcaccggatccacggttttctgcggctcggaggagtggcctcccttaccctggatactgataatgaaggtggccattgccccagaggccacgccgggggagtagttcagcttgcccacctccacctgggagcccacgtggagggccatggcagcgtctacccgcgggttctccagcaggccgtcctccaccatggtgcgggagccgtagcccatctcctcgcccggctggaacatgagtttcacggtgccgggcagctcgtcctccatctccttgaggatgcgggccgcccccagcagcatggccgcgtgggcgtcgtgcccacacatgtgagccgtgtcccccttggccgcgaagtccaggccggtggtctcctccatgggcaggccgtccatatccgcccggagcaggatgcacggtccgcccttcccgatgactgccaccacgccggtggaagtgggggcgtcggggtacccggcaaacaccatcttctcccggtcctcctgggagtggacgccgcagtcccggtgcgcaatccccatctcggtcaggcgctccttgatgtaggccgcggtcctgggcgtatagacacccacctcgggcatctggtggaggcaacgccggtcggcgatgatctcctgctcaatggccctggccttctccagtattttgttcatccttaaacactcctttttctgcccgcccggggttcaggcccgaaagaccgttctgccgttcagcacggtctccagcacctttgcctcggggaacgtatccggttcaatcgcaaacagatcccggtccagcaccacaaggtcggcctgcttgcccagctccagggtgccgcggacggcctcatcccggctggcccaggcggcatcggaggtgaacaggcgcaccgcctgctccacggtgagggcctgctcgggcagatagaccctggtgcccgcccggttctgccgggtgacggcggcgcgcaggttgtccaacacgttgaagggctccaccgggcagtcggagccgccgctgacccggatgcccagatcctccatggccttccagttgtagcactccttcgcgtgggcctcccccacccgctcggcgatgatgttcatgtcggcgtcaatgaagatgggttggatgtacgcttggaggcccagggccttcatccgctccagcagggcgggtgtggtagtctgggcgtggacgatgccgtggcggtgatccggccagggctcttcccgctccacccactcgatggcgtcgcacaccttgcggaaggccaggtcgccgatggcatgcaccgccacgtccatatgggcggtatgggccgcgcgaatccggctgcacagctcttcctcggtgtagatagggatgccgtggttgtccggctcgtccaggtagccgtcaatcatctccgccgacttggctcccagggagccgtcctggagcagcttgcgggggccggtgcggaagaggctctcccggtcggccggatcgctgcgcaccgcctggagccgctcaaagtcctcgggctccaccaggcactgctcgtagacccgcaccgtcagttctccgtccgcctccatctcccggaagatgccgatcaatcggatagggtccactccggcaatggccttcagatcgtcggaattgacacaggtaatgcccgccgcgttcagatcccgctggcccagccggatcagctcctttacataggcgtcatccgcctgggggagcaccttcatatacaggcgggcggcatcctcccgcaggatgccgttggcaaagtccaccagggccagcacctcgggcgccacatcctccagcgcgcggatgcgctccagcattatggagttgcaggccccgatgtgcaggcaggtccgcagcatacacaccgggatatcggtggagatgcggtccagatcctcccgcgtcaccaggcgcccctccgccatggtctcttgattccagcccatgccgatcaggtaggatgggtggtcccgctcaatccgggcccgcccccggtctatgatctccccgatggacgccacgccaaacagggagaggtttttctgaatcatggcgtagtggagcaggtgcatgtgggaatcggtgaagccgggcagcaccatgcctccctgcaaatccctcgtctcatcccacacctgcgccagagcctcctgaacgctccccaaaaaggtcagtctgccgtcctccgcacccaccgcctcatagcggcgcatggcgccgtccatcgaggcaaccgttccgttgtaccaaagtctccgcatatcagccttcctttccgcctgcggcaagtttcgtgcacttaactttgcaaacgggatgccagctcaccctaatgcccaaaaaaggacccgagggccggtattataggacatacctccggctctcgggccctttttcagggggaaaatattttgcggcgcaaaattttttacaggtcaaattttttcagcttgtatttcagattctgccgggacaggcccagcaggcgggctgcctgggagatggagccggcctgctgcatagcccggctgagcagctcccgctcgtaggagtccagcgcccgggtgagggaaaagctctcctccaggcgcagggcctccggcagctccggcggccggttcaggccgcccagccgcccggccaggatctcctccatgtcctccacggtgaggcgctccccccgggcgacagccaccgccccctcgatggcgtttttcagctcccgtacattgcccggccacgcatagccccggagcagccggagggcccgctcgctcagcccccgcaccctccggtgcagcttccggttatagtgctcgataaagtagtccgcaagcgggccgatgtcgcacagccgctcccgcaggggcgggagcgtcaggcgaatcacccccaggcggtagtacagatcctcccgcaggcgcccctcccggatgagcttctgaggcttctcgtttaccgccgccacgatccgcacgtcgaaggggatgtcccggctgccccccagacggcgcactttcttctcctccagcaccttgagcagcttggcctggagggccgggtccatggagttgatctcgtccaggaacagggtgccgccgtccgcctcctccagcagccccttgcgggtgagggcgccggtgtagcttcccttttccgtgccaaaaaacaggctctccagcagggtggccgggatggccgcacagttttgagagacaaaaggtcccgcccggccgccctcgctgtggagcgactcggccaccagctccttgcccgttcccgtctcaccatagatgagcaccgacgagtccagcccggccacgtcccggatgcggctcttgagggccaacatggccgggtcttccgtgagcatccggtccagggtggacaggccgccgccctccccgccacggatcacccgctggtcaatggtgtggtacttggacgagtccaccacacactccacccggccgtccaccacgatggggatggtggtggactccagcagcacccgctccccccggtggttgttgatgtcctggagaacgttgtagctggcccggcccgtccgcagggcggtaaggatggtgctgctctccccgtccagctccggatagagctccagaatgtgccgccccaccgtgtcctgggagcaccagtagctgttcagcggaatccggtggtattcgatgatcccctcccggttgaccaccagaattccgtccgtatcctcgcagaggcggagtacctcgccaatctgatccagaaaccgctccagcatgcctgctctccccttctattcatgagaatataaaaaaaatctggatttctccagattcgacggataaaacaattgacttttgttcccttttcatggtatactgaaatgctcttatcttccaatccagttttcccgattttttcccagcttggacacagtttagcatgcggggcgggaaagcgcaagaggatttgtttcttttttgtccacacagccgagcgtgtacttccttcttccccgccgcgctttgtcgggtttgacggaagacagccgatggaaaccggagagcgctgccgcccaacgctccccaaacaaagaaaacgaggtgttttttctacgatggtcaaggacgtctactacggcaagaccctccgcaagagctttgcccgccatgaagaaatcctggacatgcccaacctcctggaggtgcagaagaactcctatcagtggttcctggacacgggactgcgggaggtcttcaaggatgtggcctcgatcaccgactacgcgggcaacctggagctctccttcatcgactactccatggatgagccccccaagtacagcgtggaggagtgcaaggcccgggacgccacgtacgccgcgcccatcaaggtgcgggtgcgcctgcgcaacaaggagaccgaggagatcaaggagcaggagatcttcatgggcgacttccccctgatgaccaaggccggcaccttcgtcatcaacggtgccgagcgcgtcatcgtctcccagatcgtccgctcccccggcatctattactcccacaccgaggacaaggccggcggcatcacctacgccaccaccgtcatcccctaccggggcgcctggctggagtatgagaccgacctgaacgacgccttctacgtgcgcatcgacaagaaccgcaagctgcccatcacctgcctgatccgtgcggtgggccccaagaccgaccccgagatcctcgagctgttcggcgaggatccccgcatcgttgccaccctggagaaggacgcctgcaaaacctatgaggacgcgctgctggagatctaccgcaagctgcgccccggcgagccccccacggtggactcggccgagagcctgctcaacgccctgttcttcgatccccggcgctacgacctgtccgccgtgggccgctacaagttcaacaagaagctgtcgatctggacccgcctggtgaatcagaccctggccgcccccgtggccgaccccatgaccggcgagatcatcgccgagcccggcgaggtgctcacccgtgagcgggcccacgagctggacgacaagggcgtcaacgaggttgtactggagctcgacggcgtgcagatcaaagtattctccaatcacatggtggatatgtccaagttcgtggactttgatccggaggagtgcggcgtcagtgagaaggtacgcttcaccgtgctccaggagctgctccagaattacaccggcgaggagctcaaggaggccgtgaaggagcgcatcgacgacctcattcccaagcacatcatcgtggacgacatcatggcgtccatcaactacctcaactgcctggcccacggggtgggctccgccgacgacatcgaccacctgggcaaccgccgcctgcgctgcgtgggcgagctgctccagaaccagttccgcatcggcttctcccgcatggagcgggtgatccgggagcgcatgaccatccaggatctggacatcgtcaccccccagagcctcatcaacatccgccccgtcaccgcctccatcaaggagttcttcggctcctcccccctgagccagttcatggaccagaccaaccctctggccgagctgacccacaagcgccgtatgtccgccctgggccccggcggcctgtcccgtgaccgcgcctccttcgacgtgcgcgacgtccactactcccactacggccgcctctgccccatcgagactcccgaaggtcccaacatcggcctgatctcctatctggcctcctatgcccgcatcaaccgctacggcttcatcgaggccccctaccgcaaggtggataaagccaccggccacgtcaccgaccaggtggactatatgaccgccgacgtggaggaccagtacaccatcgcccaggccaccgagccgctggacgagaacggctgcctggtacacgaccgtatcacctgccgccaccgcaacgagatcatcgacgtggaccgggatcaggtggactatatggacatctcccccaagatgatgttctccatcgccaccgcccagatccccttcctggagaacgacgacgccaaccgcgccctgatgggcgccaacatgcagcgtcaggccgtgcccctgctgaccacccaggctcccatcgtggccaccggccaggagcacaagaactgcatcgactccgaggtggccatcctggctgaggacgacggcgtggttaccaaggtggccgccgactccgtctccgtccgctacgacgacggccgcgtggaggactaccggctcaccaagtacctgcgctccaaccacggcacctgcatcaaccagcgccccatcgtggacgccggccagcgggtggagaagggcgaggtcatcgtggacggcccctccaccaacaacggcgagatcgccctgggcaagaacatcctcatgggcttcatgacctgggaaggctacaactacgaggacgccatcctgctcaacgagcgcatggtgaaggaggacgtgttcacctccatccacatcgaggagtacgagaccgagagccgcgacaccaagctgggccccgaggagatcacccgtgacatccccaacgtgggcgaggacgccctgaaggatctggatgagcggggcatcatccgcgtgggcgccgaggtgcgcgccggcgacattctggtgggcaaggtcacccccaagggcgagaccgacctcaccgctgaggagcggctgctccgcgccatcttcggagagaaggcccgcgaggtgcgcgacacctccctgaaggtgccccacggcgagagcggcatcatcgtggacgtgaaggtgttcacccgcgaggcgggcgacgagctctcccccggcgtgaacatggtggtgcgtgtctacatcgcccagaagcgcaagatctccgtgggcgacaagatggccggccgccacggcaacaagggcgtcgtgtcccgcatcctgccccaggaggatatgcccttcctgcccgacggcacccccctggacatcgtgctgaacccccttggcgtgccctcccgtatgaacatcggccaggtgctggaggtccacctgggctacgcggccaagaccctgggctggaaggtggccacccccgtcttcaacggcgccgacgagaaggacatcgccgagaccctgaagatggccggcctgcgccccgacggcaagagctggctgtacgacggccgcaccggcgagcggtttgacaaccccgtcaccgtgggctacgtctacttcctcaagctccaccacctggtggacgacaagatccacgcccgctccaccggcccctactccctggtcacccagcagcccctgggcggcaaggcccagtttggcggccagcgcttcggcgagatggaggtgtgggccctggaggcctacggcgcggcctacaccctgcaggagatcctcaccgtcaagtccgacgatgtcaccggccgcgtgcgcacctacgagtccatcgtcaagggccacaacgtgcccaagcccggcgtgcccgagtccttcaaggtcctggtcaaggagctgcagtccctgtgcctggacatcaaggtgctggacgaccagggcgcggagatcgagctgaaggacgacgacgaggacaactaccagcccggcaagttccgcgacgaggacgacgactactacggctacgacgccggcggggagtccgacttcgccgccgcgggctacaccctcaaggagggcagcgacgacgacgacctggccgccgcggacgcagaggagctggacgacagcgacgacttctcggatgactattccgatgaggatatggactaattaagggaggacgagcaaagatatgagttacgctgaattcgacgccatccagatcggcatcgcctccccggaacagatccgcgagtggtcctacggcgaggtcaagaagccggagaccatcaactaccgcaccctcaagccggagcgggacggtctgttctgcgagcggatctttggccccaccaaggactgggagtgccactgcggcaagtacaaaaagatccgctacaagggcaagatctgcgaccgctgcggcgtggaggtcacccgtgccaaggtgcgccgtgagcgcatgggccacatcgagctggccgccccggtgagccacatctggtatttcaagggcatcccctcccgcatgggcctgctgctggacatcagcccccgtattctggagaaggtgctctacttcgccagctatattgtcaccgaccccggcttctcccccctggccaagaaccagatcctctccgagaaggagtaccgcgacatgcgggagaagtatgaggacgactttgaggccggcatgggcgccgaggccgtgaagaagctgctccaggacattgatctggaggagctgtccaaccagctccgcgccgagctgaaggacgcctccggccagaagaaggcccgcattgtcaagcgcctggaggtggtggacgccttccgcatctccggcaacaagcccgagtggatgatcatcgacgtgctgccggtgatcccccccgagctgcgccccatggtacagctggacggcggccgctttgccacctccgatctgaacgacctgtaccgcagggtgatcaaccgcaacaaccgcctgaagcgtttgatccagctcaacgcccccgacatcatcgtgcgcaatgagaagcggatgctccaggaggcggtggacgccctcatcgacaatggccgccggggccgcgccgtcaccggcgccaacaaccgcgccctcaagagcctgtccgacatgctcaagggcaagcagggccgcttccgccagaacctgctgggcaagcgcgtggactactccggccgttccgtcatcgtggtcggccccgagctgaaaatctaccagtgcggcctgcccaaggagatggccatcgagctcttccgccccttcgtgatgaaaaagcttgtggaggacggcctggccaacaacattaagtccgccaagaagatggtggacaagggcaaggccgaggtgtgggacgccctggagtttgtcatcaaggaccaccccgtcatgctcaaccgcgcccccaccctgcaccgcctgggcattcaggccttcgagcccgtgctcgtggagggccgcgccatcaagctgcaccccctggtgtgtaccgccttcaacgccgacttcgacggcgaccagatggctgtccacgtgcccctgtccgccgaggcccagaccgaggcccgggtgctcatgctctcggccaacaacctgctgcggccccaggacggcggccccgtcaccgtgcccacccaggacatggtgctcggctcctactacctgacctatgagaagtatcccgagcacaccgccgaggagacctatgacgacgtggctgcggtgaaggccgccctggccgcgggtgccatcacccccgattcctatgtctgggtgaagaaccccggctccctggatgatattcccacctacgccggcatctgcgccgagaccgaggacggcgcgctgccccgcgaggtgctccacgtcttctccaacgacatcgaggcccgcctggcctacgacgagggtgagctggagctccacgtgcccatcctggtccgccgggaggcggaggtggacggcgttgtccgccacaagctggtgcgcaccaccgtgggacgcctgctcttcaacgagggcatcccccaggatctgggcttcgtggaccgcagcgaccccgagcagatgttcgaccccgaggtcaacttcatcgtgggcaagaagcagcttggcaagatcatcgacaagtgcatcgtcaagcacggcttcaccgtgtctgcccatgtgctggacaccatcaagaaccggggctacaagttctccacccgcggctccctcaccgtctccatctacgacatgaccatccccgagagaaagtacggcctgatcgccgataccgagaaggagatcgtcaagatcgagcggcagtacaagcgcggcttcctcaccaatgaggagcgttaccgcctggtggtcgaggcctgggaaaagaccaccaaggacgtgaccgacgccctgatggccggcctggaccgctacaaccccatctggatgatggcggactccggcgcccgtggttcctccgcccagatccgccagctggccggcatgcgcggcctgatggccgatacctccggccgcaccatcgagatccccatcaagtccaacttccgtgagggtctgtccgtgctggagtacttcatctcctccagaggcgcccgaaagggcatggccgacacggctctgcgtaccgccgactcgggttacctgacccgccgtctggtggacgtgtcccaggaggtcatcatccgcgagcacgattgcggcaccgacgacggcatcaccgtcagcgagatcgtggagaacggtcaggtgatcgagaccttcggcgagcggctcaagggccgttacccggtggaggatatctgcgatccccagaccggcgaggtgctcatcgaccaccacaccatgatgaccgccgaccacgccaagctgctggaggaccacggcatccactccgtgaagatccgcagcgtgctcacctgccgcgcccgcagtggcgtttgttccaagtgctatggcatcaacctggccatcggcgagcccgtgggcgagggcgaggccgtgggcatcatcgccgcccagtccatcggcgagccgggcacccagctcaccatgcgtaccttccacaccggcggcgtcgccggcggcgacatcacccagggtcttccccgtgtcgaggagctgttcgagtcccgcaagcccaagaagatggcccagttggccgagatcagcggccgggtcactctggaggaggccaagcgcaacgccatctgcaacgtcaccatcaccgccaacgacggcgaggtggtctcctacgccctgccctacgcgggcctgcgggtgaaggacggcgacaccgtggagaagggctttgcccttaccgagggtgccctctacccccaggacgtcctgcgggtgcgcggcgtccacgccgtttacgactacctcatccaggaggttcagaagccctaccgccagcagggcgttgacatcaacgacaagcacatcgaggtcatctgccgccagatgatgcgcaaggtgcgggtagaggacgcgggcgattccgatctgctcagcggttccaccgtcgatctcatccgctttgaggatgccaaggaggccgtgcagaagcgcatcgacgccggcgagaccaacgacggcctcgagctcaagctgcccacctgcacccgcctgctgatgggcatcaccaaggcctctctggccaccgactccttcctgtccgccgcctccttccaggagaccaccaaggtgctcaccgaggccgctattcagggcaaggtggaccacctgctgggcctgaaggagaacgtcatcatcggcaagctgattcccgccggctccggcctgtccgtctaccgcaagtacgacaaggtggacgacgagggcaccgcccagagcggcgaggaggcggttcccgaggaagaggcccccgccgaggcggcggtcctctccgagtccgctgaagtctgatcccactgtgaaaggcccggggcaccccattgccccgggccttttttcgacaggaggtgcctatgaacgtcttttccctctcctgggccgcagctggactggccctgctgggcctgagcctgtttcccgccggctcccttgccctgggcggagcgcccgctcatctggccgtctttctgctcctgctggccctggccgctctggcgctgcggctgctccgccgggagggcctggaccgtccccggctgctggacgccctgctgcccattgggctggccttcttcctccgggccctgctgctggactaccagtccgccgattaccagatgttcctctcccaatgggccgcggccttccgggatgggggcggcttcgcggccgtgaagctgccgatcggcaactataacgcgccctacctctattttcttgccgccatctcctatctgcccatacccgacctgtacctcatcaagctcttctccattctgttcgacgtggtgctggcctggggcggcttccggctggtgcggcatttcgcgccggagagcccgaaccgccccctgctctgcttctgcctgcttctgctgctgcctacggtgatactcaacggcgcgttctgggggcagtgcgacgccctgtacggcgccctcaccctccacgccctggcctgcgcgctggaggggcgaaaccgaagctctttgctcctgctggggatcgccttctcctttaaactacagaccgtctttgtgctccccctgtggggcgggctgtggctgctccggcgggtgcgcttccgggagctgttgtggtttccggcggcctatgccgccacctgtgtgcccgcgctgctgctgggcaagcccctgggggacatcctgggggtctattttgggcaggccgccgagtactccggctatctgaacctgaatgcccccaatatgtacgccctgattccccacggcgcggaggtgaacactgccctcgccgcccgcctgggcatcctggccgccttcgccctcgctgcggccgtgctggccgccctgctggttttccgccgccaggcggacgaccgggctcttctggccgccgcggttgtcctggccatcggcgtgcccttcctgctgccccacatgcatgagcgctacttcttcctggccgacgtgctggctctggcctggacctgcgcgttcccccgctccgccccctgcgccctgctggtggagctggcctccctgggcgcctatgtggtggtcctgcgggggaaatttaccctggcggtctccctggatggccgcctgttccccatgctgtgcgaggccctgctcatgctggccggcctggcctttgcggtcctctccctcgcccgccgactcgccttccctcaaaaatccagagagtaacagcctgtcccctaccatctggcatgccggtacaaatttcctgtgaaatcagcaggaaagcagttgacgagctggaaacaatgtgttacaatttggttacagtttttaagaatagttacaattctcaaaggaggtcaaaatggcagctcagaatattcccctgacctacaagggccaccccctccgccggaaggacagcctgatctactacggcagcatggcccagaaatatatcatcatgctccagattctctcccagaagaaggatcaggatctggacgtggcgaccaaggtttccgttcagcttcagctcaccgacccggatctgaagagccgggaccgggtggttaagaaaactgagaaagacagcctctacgccgccatggacgtggcgtccgtctggctggagcgcgcgctcgccaacccgtaatcccgccttacacccgagaagccaaagccccgccctccgggcgggtattactttgaaactggaggaatcgacccatgatacagcctgccaagctcctgcgcaccgcgcttgtaaccgccgtcctctccaccgtctgcgtggtgagcgcctccgccgccagcgtcggcgtgggcaccgtcaacaccgacgcactccgcctccgcgacgaggccagcacctccgccaccgtactgggtaccgcctccaagggcgacaccgtggtggttctggaggacgcgggcaacggctggtacaaggtggactacaagtccgtggagggctatatgtccggcgagtacctgaacgtgtccgccaaggcggatgtcaccatcggttacggcctggtccagtcccagggttctcccctgaatgtgcgcagcggccccggcaccagctacggtaaggtcacctccctcaacaacggcgcggtggtcaacatcgtgggtatcgacaacggctggtacaagatctctaccaatggcgtcaccggctatgtcagcagcgattacatggtcacctgcaaggactccgccggttcccgcggcgacggcgccaccgccgtagccaccgcctccagcagcagcctgggccagcaggtggtggactacgccaagcagtatctcggctgcccctatgtttacggcggcaactgccccagcagctttgactgctccggctacaccagctatgtgtaccgccacttcggctacaccctgaaccgcaccgcctccactcagctctccaatggcacctctgtttccaagagtgagctgcagcccggcgacctggtgttcttcaagtacaacaccagcaaggccgcctctcatgtgggcatctatatcggcggcgggcagttcatccacgcctctaccaatacatacaccgtcaagattgacgatcttacccgcggccactacgccaacgtctacgtgggcgcccgccgcatcctgtgattttgcctggcaggcgaatccggtctgagttgaaaacgagcgtacacggctctgccgtgcacgctcgttttatgttttcgtatacgatgcagttttaggagggattttcaaatggatctggcctttctggaggaaaccaagttctgtctcccggcgcgccggagctgccggaatccctcgccggccttcccatcgccctgccccacgctccccgccctgttcggcacctggtggagaaatccgtccccctctccgtggggagggtatgcgccttctcctttgccgctccccgcggcggcctcgccctgtgcaatatcaatgccgtcaccctttctttgcagacaatcgccgtatactgcattaggggttgatgttgtccagtcacaggaacagggcccgccggatggcgggccctgtcgggtcagatgcttattcctggggcttgtcgtcgtcggagaatacctcctcgggagccacctcgtgatcgcagcagccgcagccgccgtccaccggctcctcagggggcacgtcggtctccacgtgggggatgtccgcgtcggacacattgccctcagccttcagctcggcgatgcggttcttgttctcctcaatgttgaccttggcggcggtgatgcgctcacacagggccacgtaggccgcctcaggggccatgccccgctcggcatagtatagcttgccgatctccacatacgccttcttgatggcgtcctcctcgctggcgttgttcagggacagcttggtgatctccgcaagctgcttggacttggccacgccggcccggcccagatccattgcacgatccttcagttcatccaaaaaagccatattaaaaacctccttacggtgcggcttgttgggttgctggccttattctaccccgttttgccccggtgcgcaaggggacgcgccgggattttagccaattttaaccgatcctatagcggagcttaaattttgcggccttttcttgccctttggcccgcactgtgataaaatcatatcatttcactgggggaattctcccccggaaaggagcacccatgaaactgttgatgacggaccgtcccgtgtccgccgctctcccccaggatgccgccgccgtggatctctccgccctccgcatcgcaaactgcgtgggctgcttcggctgctggaccaaaacgcctggccgctgcgtcatccgggacgacgcggtacgggtatatcccctcatcgcccggagcgagcaggtactctatgtcagccgggtcaaatacggctcctacgcgccggtaatgaagaccatgctggagcgggccatcccggtgcagcaggcctttctccgcatccacaacggcgagactcaccacgttcagcgcgccgtggtccccaaggacgcggtgatcctggcctacggggcggaccgggcggaggagcgcgccctgttcacccggctggtggagcgcaacgcccacaacatgtccttccgcagccaccgcgtccgctttgtggccgagggggagctggaggccgccgtgggagaggaggtggcccggtggtgaagtttctgatcgtaaacggcagcccccgcgccccccgctccaattccaggcgctatgccgagctgtttcaggcccgctggaagggggaggcccgctatgaggccctgaccgcaaagaatcacgccgagctggcggcggccgcggcggagtgcaccgacctgctgctggtcttccccctctatgccgacggccttcccgcccctctcctgcgctttttggagttcctggagggggccgggccggagcacaggccgcgcatcagcgtactgatcaactgcggctttctggagccacaccagaacgatgtagcggtggacatggtgcgcctcttctgcctggagaacggctatcccttcggcgcatgcctcaaaatcggcggcggggaggccatcctgggcacccccttcgccttcctggtcaggcggagcatcagggcgctggccagggccgtcgccgccggacggtccgccgagctggcggtcaccatgcccctgtccccccgctcctttgtgcgggcctccacacgctactggacgcagatgggcgccgccaacggctgtacgccggaacagatggcgtccatggacattgagccgcagccttagaaaaaggtgagctgccgctccccgtagccgcgctgataggcggcggtgatgtcccgcatccggcacagcaggcccaaggcgcggcaccgctcctccagggcggcccacagggcctttgcccgtgggcttgggcactcgtagcggggtccgtactgccgccggtagcgttccgccaggccgggaaagcctttttccaatgcctgatagtaatattcccgctgttgatcacggagcgtcataccgaacgcggggtagacaaaacgggcccccgcctccgccgcggcctccaccacggcccgcaggttttccacattgtcctccaaaaaggggagaaccggcatgagcagcacgccagcaaacacccccgcctccgccagccgggccaccgcctccagccgccgggcggggctgggagcgttcggctccacccgggcggccagggcggcatcggtggtggtgacggtcaccttgcacagcaccggcacgtgctccctcatgcagcgcagcacgtctatgtcccgggtaatcccgtcccccttggtggcgatggccgccccgaagccgtaggcgtccagcagctccagggcgtggcgggtgagctggagctccccctcgaaggggttgtaagggtcgctcatggagcccatgcccacaatgccggggcgcaccttccgccgcagctcgtcccgcaggagcgccagggcgttctccttggcccgcacccggccgaaatcctcgatgccgtagcaggcgcttcggctgtcgcagtagatgcagccgtggcagcagccccggtacaggttcatggtgtagtcggtgccgaaccaggcggtgctcctgttgcggcttaagatctgcttggcgggaatgtactccatggccgttcctccgtatggtttttcccccgcctccatatcctagtggggaatggaggtggagcatgagacgcaagctgcccctttcgctccggatcctgctgggcctggggctgggcgtgctggcagggctggcgctccagaatgccccggagtttgccgcggcctggattcagcccttcggcaccctgtttctcaatctggtaaagatgctggtggttcccctggtgttctgctccctgacggcgggggtgggcggtctgggggacgcccggcacatgggccgggtcggcggccgcaccctcctgttctacttgtgcaccaccgcgctggcggtggccctgggcctgctggcggccaacctgtttccggtggggcgggagctgggttatccgctccccgccgcccgggaggaggccccctctttctctctggcggacaccctgctagggattgtccccaccaatcccatccaggctctggccgagggcaatatgctgcagatcctcttttttgccctggccctcgggtgggcgtccctgaccatcggagagaagggtgcgcccctgctgcgggccttcggcagtctggcggaggctatgtacgccctcacagagcggatcatggtactggcgccggtggccgtattcgccctgatcgccccggtggtggccgcagaggggcccagagtgctctcctccctcctgggggtggccgtcctggtctacggggcctgtctggtgcagcttctgttgatctacggaggagccgtgggcgccctggcaaggcgcagcccccggcgtttcttccgggaggccctgcccgccgtggtcttcgccttctcgtcggccagctccgccggggcccttcccttctcgctggaggccgccgagcgcctgggcgtccccgccggggtgcgctccttcgtgctccccctgggtgccaccctcaacatggacggcaccgccatctaccagggggtgtgcgccctgttcatcgccaatgcctacggtatccccctggcgctcccccagcagctcaccatcatcctcacctgcaccctggcctccgtcggaaccgccggagtacccggcgcaggggccgtcatgctgggcatggtgctccagtccgtgggcctgccggtggagggggtggcattggtcctgggcatcgaccgggtgctggacatggcgcgcaccgccgtcaacgtagcgggcgacctcgcctgcgccgttgtagtgtccgccgccgaacccccggttgaaaaggggcctcccgcctgagggaggcccttttttacgtctgttcgggggtggtaatccagagggtgttttcctccgcgtcccacacgtcctccagccccgcggcgtccaccataaagcgcaccgggacatagagcttccaccccaccagctcaggcggcaccgccatggagaccgggccgcgcccggacacctggccctgggtgatgcccacccggacggtgatgctctccgccccgttgctgcacaccgccgtcccggtggccgcatcgtaggagaagtcataatatcccatccagaccgccagttcccgcatcggggccatggtgcaccctgctgtgctgcgcaggggcatatcggtcagggagaaatattccccgtccagagccacataggtgggaaactcgccgaagcatgcggcgcagagcccccggacctcctccgagtccactgccagaacgtcatccgtccccacaccagttaccaccgtgccgccccctgaatggagttccacccccgtggagctccagggacacagggccgtgaaatacaccccgtcgccggaggccagcagcttcccatccgccacccggtagaccagcgaaccgtcggtctggccgtccaccgggcaatccttgatgcgccatcccagatctatctggggggccgcctccggcaggacggtcaggctggtggccgtccattgctcccggtcagcgctttgccagacggttccgtccaccagcgcatagcacaccccgtccacacaggccacgttctccaccggtgcgccgaagtcgtgctcccccgtccggtggaagctgcgatccaagaaaatgaccttgttgttgttcgggctgaaccggtctgcgccggtacccatcatcccccggccggtgacagactgacacataagatagccgtcccctgtccagcggaaggtatagtccacccaggccgttccaacgccctcggcggggtcaaagcccaggtcggcctccacccatccggcggtacaggcccctgcaaaacggctgcccctgtagtcatggtagtacagcgaaccgtcatacgggctgtagtagaccacggctcctcccccggtctcggacaggcgcatcatgtcaggggtcagcttggtctccagcggcagccaggagtagccgtctgtggagaccgccagcccaaagggaccgttgtttccgggctgctcccggataagatagctggtcacctccacgggcttacgctgattctcctgcttgtaccaggccgtgccgctgtagtagacgccgccctcccggcccggctcccagtcggtccgggtgaaggcgtgctccaccccgtccacggtggcgtagtaggtgccccccgcgtaccggatatcggtgaccgggccgtcaaacgccttggcgccgatgatgcggaagccctcgtccaaaagggtgacccagttgttgcggggactgtccccatattgctggtgggtgtcctcccggggatcgtccagcagactctggcgcatcatgtactcactgcccgtccacagaaactggaactccttgtgagccagtccgtttacaccggtgccgtaggcccagccagcactcgcccactggcgatccaactccgtccacgtcaccccatctgcggagcggtacacgccgcctatgatggtgtagtacagcacatagtcccttccggtctcgcacaccaccgggcccgccatggcccccagggggccgtcccaattgggccgccccgccgccagcgcgggagtgactagggtgagaaccaacgccagggcggcagccagcgccgaaattgcacgccgtctcatgtttacccctcctgaattgctgtggtgaggtagaaggtctgccccgccgcatcccaggtcacatccgcccccgccgcctcggcaaagaatcggacgggtacacagaatatgccaccgcgcagctcggcgggcaccgccagccagttggtggtcttgccgttgacggtagcctgggtgctggccgcgcgcacagaaatggtgtccgtcccccgggcgcataccgccgtcccggaagagccgtcatagtcaaaggtatagccaagagcctgggccatctgccgcagaggggccatcgtgcagccgctcacctgatagagggagatggggaaagtcaccggcttgccgtctaccgtgacccgcagcagctcgggctgggcagcggccaggcgctgcttcaactccgccgccggataggtgtgggacgcgccggtctcgtagccataccggctgtagacctccacccggatgccctggggcaccggataggcctgcacatccgccatgtcgtagctggccaggaaggaggtaaagtccgccgtcaactccacggcccgcccctgtccgtccgtcacccacagctcccggccgccccgcagggtgaaggtgaggccgttcagcgacgaccggccccgctggatggccggcgcggtatcttgctcctccggcgtgagggccgtccagtgccccccgtcggcggagcaccaggtgggccgctcgctcccgaaggggccggccaggaactgcgtcccgtcgtacatgccgctgcccaggctgctctccgccgccccggcggagacccagctcaccccgtcgtcggtgtagacaaactcataccggtcgtcccggtacaccgcgccgtctgccgtctgccggtacgctccgtaggtggtgcggacgcccaccgtccgcgcgccgctgctgcccaggatgcggatgtaggtgtccccggcccggtgctccgccgccagggcgggaatgcccagggtgagggccagcgccagggccagcaggatcgacagaaaccgtttcatgaaaacctccttttccggcggcgtggcattcccgccttacgaattcttcttacggaatgcaaaaaaccgctgtccgaagtaattcagaccggtgtaaagcaccatgcccaccagcagggccacattctcctggatcttcccgctctgcccggagagggcccacagcgccagaggcttggccacgccgtaggcaatgagccagcacaccgctaccgtcagggcgaatctgcccacctgggcccagccgcgctccttattctgaaaggtaaagtgcttgttgaggaagtagctcagcacaccgcccaccacgtaattcgccgccgaggctgtccagtaggcccagcccgccaggttgaacagcaggaacataacgcccgcccccaccagggtgttaagcactcccaccatcaggaacctggggatgctcttgtcaatcagctttttcgccatgcgcatcctccagtacctcgcggagcaggaaacgggggcgtcccttggtctccagatagatcttcccgatgtactccccgatgacccccagggagaggaggatcagtccgccgatggcccacaccgagcagatcacgctggcccagccgatgatggtggctcccgtggcccagcggacgatggagtagatcagcatgaggatgctgacggcaaagatgaggaagcccaggccggtaatgtagcggatgggcttgacggacagggatgtgatgccctccatggcgaaggagagcatctttttcagggggtatttgctctcgccggcgaaccgctccccccgctcgtactccacggtgccggtgcggtagccgatcatgggcacgatgccccgcaggaacaggttgacctccctgaactgggccagcccctccagcgcccgccgggacatgaggcggtagtcggcgtggttgaacaccgtctccgcccccatgaaattcatcacccggtagaagccctcggcggtgaagcgcttgaagaaggtgtcctttttccgggaggagcgcacgccgtagaccacatcgcacccggcgtagtactgctccaccatggcgtccaccgcgtcaatgtcgtcctggaggtcggcgtccatggagatggccatgtcgcaccgctccttcgccgtcatcagccccgccagcagggcattctggtgcccccggttgcgggagagatccgccccgcagaacagggggcacccgccatgcagccgggtgatgagctcccacgtccggtccctggagccgtcgttgacaaacagcacccggctccgctccgagattttgcccgccgccatcagcccttccagcttggcccgcagccgccgggaggtctcgggaagcacctcttcctcgttatagcaggggacgacgatatacagaatatctgccatccggtctccacttccttgtctttggttttggtatctgccattataccctctttggacgagaaaagccaccttatggttccccgttgccaaacagggaaatatccagcaccgcacaaatgcgcatcagcacatccactgagggctttttccggccactctcaatttcggcaatgaagggctgggacacctgtaccagctttgcaagcctttcctgactcagtcccttttcttttctcttttcccttatcagagttcggtaatccattccaatcactccttgctcctattatagctaatagcaatatctttttcatctatagcttttagctattgacttttttcttactttgctataatatagctataagctatttagaaggtgctgatatgaattctttctttcctatcctgaactgggccgggcttcttctgctaaaggaaaagctgtcccactgcacgccttatcaggaggcagagcgggacagccgtgcacagtgggcggcgttcaaagcctcccacccggaggctttgaacgaggaggtgctggatttgcttgaccgctgcaatctggctgcggcctgggagcgcgacgccgccttttgtctgggcctccagttgggcctggagctgggcggccttggccgcttctgggatacggagccgtagtggatgacactccagtatggcgcgacagcgtaggccccgccggaggcatgacaagaaagcagttgtcaaaaactgcaacatgaaaggtgcgtcagcccggcacaagacgggccgatgtgggcagaaggtgaattgccctagaggggcaagagaggccgccctggggcggcggcccctacgctagggggacgcccgcctcaacgtatcacggcgtaggggcgaccctggtggtcgcccgcgggcggccataaaggccgcctctacagggttgcggaagcgcaggccgatgggctaggggtaaattacgccaaaggggcaaggaagaccgccctggggcgtcggcccctacgctagggggacgcccgcctcaacgtatcacggcgtaggggcgacccttgtggtcgcccgcgggcggccataaaggccgcccctacagggttgcggaagtgcaagccgatgggctaggggcaaattacgccaaaggggcaagagaggctgccctggggcggcggcccctatgctagggggatgcccgcctcaacgtatcacggcgtaggggcgacccttgtggtcgcccgcgggcggccataaaggccgcccctacagggttgcggaagtgcaagccgatgggctagggcaaattacgccaaaggggcaagataggccgcccctactccagcttgcggcgcaggtgctccacggccttgcgttcgatgcgggagacctgcacctgggagactcccagcaccttggcggtccgatcctgggtcataccccggaagtagcgcagcaggatgacctgccgttcccgctcgggcagggcggccaccgctccccgcagggcctcccgctccacgatggcctcctccatgccctcggtgcccagcacgctctccagggtgaagccgtcccccgtctccatctggagggaggccactgggaggtttgcctcctcggcggcggcgatctcctccggctccagtccggtctcctccgccagctcggagagggcgggctcccggcccaggcgggcggacaggcgctcccgggcggagcggatggcccccgcccgctccttcagtccccggctcaccttcaccgccccgtcgtcccggaggaagcggcggatctccccggcaatcttgggcacggcgtaggtggagaactggcagccgaaggcggggtcaaagccccgcaccgccttcagaaatcccaggcacccgagctggtacagatcctccgggtcggttccccggccgtagtagcggcggacgatgctccagatcagtccggcgttctcctcgatcagccgggcacaggcgtcgttgtccccccggcgggcctcctccagcagggcgggtgtatccgctacgctcacacgggcgcccccatccggcgggagaccctgcgccgcagggtgaccacggtgcccttgccgggggtggaacgcaccttcacggcgtccataaagctctccataatggtaaagcccatgccgctgcgctcctcggttccggtggtgtagaggggctggcgggcctgctccacgtcggcaatgcccacaccccagtccttgacctggatctccagggtgttatcctcaaacagccgcagtcgcatggacaccttgcccagccggtcggggtaggcgtgtacgatacagttggtcaccgcctcgctgacggcggtcttgatgtcgttcacctcgtccagggtggggtccagttgggccgcgaagcaggccgccgccgtgcgggcaaagccctcgttggccgagcggctcagaaaggtcaccgcggcctcattgatgggtttcatcttatgtaaacctcccgtcattcaaattccatgagcttgtccagccctgccgcccggagcaccttgcccgcctgggcggggacatggaccaccttgaccgcgccgcccagctctcccaggcggcggtaggcccgcagcagcaccgcgatacccgagctgtccataaaggtcacgccctccagatccagggtgagcgaccggggcagctccaggtcgatctggcggctcagctcctccatgatggccctcgcccggtggtggtccacctcgccgctgatggcggcccggagcacccgcccctcgccggtacaggtcactgccatagcttgtccctccttgttgacacaaaaaaacgcagtataccaaaatctggtatactgcgatcatagcacagccggtatgcgatttgcgtcgatcccttatcgcaccattgaaaaggtggtaaaaatccaccgctcccccacctgctcgtagaggaaatcgtgggtctcgctccccaccacggaaaatccctgttgcgggtccagcacctccaccgtcacccgaacggtgcaccggccgggcgtaccgtcccggagtacctggacggtctcttcgcccttggtgatgtccgcgccgcggccgccgtcgatggtgtagagcgcgccgtccagctccacatactgcgtcccgtccacggggagcagctcctccaccagcccgtcggaaaacaggcttttcaaataaccccgcagatccgccagggttttaatgcccgggtagtccacccggcagtagacctgctcccccacggttctctggtcgtcacggtccagcggcatgggcgcaatctcgaaccagccccaggcctcctccgccttctcgtaggccgccaggatggcctcgtccgcaggctcatccgccccggacgcgggggtggaggttggagccggggtcggggtcggaggtgggacgggtgtggggacgggctccgcctcctccggcgtgggggcgggcgtacgcaggggtgggctcgcctccgccgaaggaatggggctgtccaggatggtctgggtagccggaggcgtgggccggtctgccgtgccgctgctctccgcagggctggccggaacgcacccccagcagcccgacagcagtatgacaagagccagcaacggcatgagttttttcatggagcttggccccccttccgtttttatcctgtgtttgatctattctatccgctggggactcattctacaactacagatgtgttacaaaaagcaacaaaaacgcgcggaaaatgccgcctgccgaagagggcggcggcatttctccgtttttatcctgtttacgccatggaagcggcggattcctccagtttggccaggagggcccggagcttttcagcccggtcctgctcggcctccaccacgtgggcgggggccttgttgacaaagccggggttgcccagcttggcctccagcttgtccagctcggcccggttcttcttgagctccttctcaatgcgggccttctccttctccagatccaccagctcggccaggggcatgaacagccgggcggcgtgggtggtgacggtgaccatgccctgggcggtcatggcgtcgtcgctgcccgcgtcggccacgccctccacggtcacatcgctggcgtaggccaggcgcttgaggaagggaatcccctgctcaaagacggcccgctccagggtggagacggtgagctgcgcctttttggaggggggcacgttcatctcggcgcggcgggcgcgcacgccccggatggcgtccatgatcagctccatggccttctcctcctccgggaagtccagctcggcccggtgctgcggccactgctggagcatcaggtaatcgccgctgtggggcagggcctgccagatctcctcggtgataaagggcatgaaggggtggagcagcttgagggtctcggtgagcacgtagcagagtacctgctgggcccggagcttgctgtcctcgtcctccccctggaggcgggtcttggtcagctcgatataccagtcgcagtaggagtcccagatgaagtcgtacaccttctgggcggccacgcccagctcgtagcgctccatgttctccgtgacctcggggatgacggagttgagcttggagaggatccacttgtcctccagctccagccggccgggcagctcgcaccggtcgatggtcaggttcatcatcaggaagcggctggcgttccagatcttgttggcaaagttgcgcatggcctcgcaccgctcggtgtagaagcgcatgtcgtttccgggggagttgccggtgatcaggttgaagcgcagggcgtcggcaccgtactggtcggccatctccagggggtcgatgccgttgcccaggctcttggacatcttgcggcccttgtcgtcccgcaccaggccgtggatgaacacggtgtggaaggggggctttccggtgtgctcgcaggcggagaagatcatccgggccacccagaagaagatgatgtcgtagccggtgaccagcacatcggtgggatagaagtacttgaagtcctcgctgctctcgttgggccagcccagggtggagaagggccacagggcggaggagaaccaggtgtccagcacatcctcctcctggcggatgtgggtggagtggcagtgctggcactcggtgggatcggtctcgctgacggtcatctcgccgcagtcctcgcacgtccaggcggggatgcggtggccccaccagagctggcgggagatgcaccagtcgtggacgttctccatccagttggtgtagatcttggagaagcggtcggggacgaacttgacctccccgtcgttgaccacccgcagggcctcgcgggccagaggctccatcttcacgaaccactgggcggagatgatgggctccacgtcggtgccgcagcggtagcaggtgcccacattgtgggtgtgctcctccaccttcaccaggtagccctgctcctccagatcggccacgatggccttgcgggcctcgtagcggtccatgccggagtagcggccgtagccctccaccaccttgccgttgtcgtccagcacacggatggactccaggttgtggcgcaggcccacctcaaagtcgttgggatcgtgggcgggggtcatcttcacgcagccggtgccgaactccatgtccacataggcgtcggccacgatggggatctccttgttcaccaggggcaggatgcacttcttgcccacaatgtcccggtaacggccgtcctcggggttgaccgccacgccggtgtcgcccagcatggtctccggccgggtggtggccacggtcacatagcggccctcctccccggcgatggggtagcggatgtgccacaggtggccgggcttctccttgtactccacctccgcgtcgctcagggcggtgacgcagtgggggcaccagttgatgatgcggctgcccttgtagatgaggcccttgttgtagagggacacaaacacgtggcgcaccgcgttggacaggccctcgtccatggtgaaccgggcgcggctccagtcacaggaggcgcccagcttcttctgctgctccacgatgcggttgccgaacttgtgcttccagtcccacacacgctccaggaacttctcccggcccagatcgtaacgggtcaggccctcgctcttgcgcagctcctcctccaccttgatctgggtggcgatgccggcgtggtcggtgccgggcacccacagggcggcatagccctgcatccgcttgaagcggatcaggatgtcctggagggtgcagtccatggcgtggcccatgtggagctggccggtgacgttggggggcggcatgacgatggtgaacgggcgcttgtccgggtcgcggtggccctcaaagcagccgttcttctcccacatctcatagacgcggccctccacctcccggggttcatagaccttgggcagttcttttttcatctgttacactccttttcggggcaaagcaaaagggcccgccccaagcctgttgctcagggcgaacccgtaagtccgcggtaccacctgaattcccccatgaagccatggaggcgctcttgtctcgctaacgggagaacccgccgggccctactgtattcaggcccggagctccgggacgaccttccccgcgccgccggagggccttgcaccatccggcccctctctgcaccgcccgcgcgggtactccttcccttcgtcgctgtgtatcgcatttagtatatgcaaaatcgggaaaaaagtcaaggcaaaacgcgatatccccgtgtccggcggaggttgttcccccctttaccgcagctccttgtcgcagtaggcgcagcagtccacgccgccgttctgcttcaccaggggaggcaggtagtgctcggtctgggtgatgcagttggggttggagcacaccggcttgacgccgatttccaccggctccggtttttcccgctcctggttggccagatcggtgagcagggccatgcgggcgtacattccgtagcgggcctgctcgaagtagaccgcccggggatcgtcgtccacgtcgatggcaatttcatccacccggggcagggggtgcatgaccagcagttccttcttcgcccggtccagcttccgccgggtgaggacgtagacgcccttgcagcgctcgtactccagggggtctacgaagcgctcccgctggatgcgggtcatgtagagcacatccaactgagggatgacggcctccaggccggtgacctcggtgaaccacatgccatgctcccgcataaaggcccgcatgtactcgggcaccgccagctcacggggggcgatgaggaaaaacttgatgccctcaaacttggccagggccttgatgagggagtgaaccgtgcggccgttcttcaaatcgccgcacaggcccacggacagcccgtccaccttgccccgcaggcgggtgatggtggtgagatccgcagtggtctgggtggggtgcatgtggccgccgtcgccggcgttgatcaccggcacgtcggagtacagggaggccgccttggccgcgccctccttggggttgcgcatcaccaccacgtcggcatagcccgacaccatcttgatggtgtccttcagggtctcgcccttggcggtggaggtggacttggggtcggcgaagccgaacaccgtgccccccacccgcagcatggcggtctgaaaggaaaagttggtgcgggtggacggctcatagaacaggctggccatcacccgcccacggcaggcgtccataaaatcggcggggtggtccataatatcactgcaccgctggtacagggactcccactccgccctcgtcaggtctccaaagtcgatcagatgccgcatgacgcttcatttccccttttgaattttttctatcgtatcatatttcccccggcccgggcaagagcagaacggacaaatttttacacttttttctcctccgccttgtcagtccccccgccctgttaaaaactgcatcacatgatctctcccgcttcgcctcatgctatgaaaaacggacgaagcggggcggttttatggtgtggttttggtactttctgatctacagttttctcggctttctggtggaggtggcctatgtccgcctggtgggtggagtcaaacgggaccggaagtgccgtctggtactccccatctgcccggtgtacggcctgggggcattggccattctcctcctgccgcctctggtccgggacagcctgccccttctcttccccgccgccgccctggtgtgcacggcggtggagtatgtgaccgggctgttttatgaaaaggtctttcgggtatccttttgggattactcccacctgcccctcaatctgggcggacgggtatgccttctgttcgccctgttctggggggtactggccctgctcgtcctccatgtgattcatccggcggcggcctggctggcggcgcggattccgctgtgggcattccctccagccgtgctggccacggcgctggacacgctcctcaccgcccggctcctgcgccggaccggagaccccaattccctgcgctggtatgcccgcctgccccgccgccggccggcataaagcagggcgggggcggccacgtgccgctcccgccctttttgcatctacgcccggcggagttcactgagggtctcgtcgatcttcttctgcggtacgtatgcctgggccacagacaaaatctgctccagggtgatggtgcgggccgctcccagcatggggtgcttcatcagcatggggaaacggcgctgaaacaccgcccgggcccccgggtggtccagcagctcccccaccgtgatctgattgcgcttcaagtccattggcttcacctcccagctatcctatgccgggccggcgggagatttgacttgccaccgccggggacaggcgctataatgatagatatcactgtagaaagggagaggaaccagcagacatgatacagcgctttcgcgggcattcgcccatcatccaccctgccgcccggctggccgccaatgccaccctggtgggctgcgtgacggtggaggccgcctccagcatctggtacggggccgtgctccggggggatgagagttccatccacgtgggagcgggctccaacatccaggacaacgcagtgctccactgtgacgcagactgccccaccgtgattggccgcgacgtgaccgtgggtcatggtgccattctccacagttgtacagtggaggacacctgcctgatcggcatgggagccatcctgctcaacggctgcaccatcggcgcgggtagcctggtggccgccggggcgctggtcacccagggagctgtgattccgcccggcagcctggtggtggggtccccagccagggtggtgcgctccctccggccggaggaggccgccgaactgctccagtcggccaagacctaccgcactctgtccgctgagctgcttcccaccgccgaggcgtccgaaacaggaggaagcgtatgaaaaggaaagggaaaattcccggccgttatcataaaacattgaaggaacaggtgcgtgagaacccccggctggccgccgtctacgtcattctgcgggtgctggtggtgctggccctggtggcacaggtgtttaacgggaactttgaaaacgtgttcctgtgcgtgctcaccctgattctgttctccatccccagcttcatcgagcgcacggtccgcattgatatcccggacaccctggaagtcatcatcctgctgttcatcttcgcggcggagatcctgggggagatccaggcttactatgtccagtttccctattgggacaccatgctccataccctcaacggctttctctgcgcggccatcggcttctccctgctggacattttgaaccgggacgagcgtctggccttcaagctctccccggtctatctggcggtggtggccttctgcttctccatgacaatcggcgtgctgtgggagttcttcgagtgctttatggaccagatgttcctgctggacatgcagaaggacacgatcgtacactccatcggctccgtgatgctggaccccgccggcggcaacaccccggtggccatccacgacatcaccgacgtgattgtgatcacggctgatggagcccagcacccactgggcctgggcggttatctggatatcggcatcctggacaccatgaaagacctcttcgtcaactttatcggcgcggtggtgttctcctttatcggctatttctatgtaaagaaccgcggcaagggctggttcgccaagcgcttcatccccaaggtcctcccggagtccggcgccaaaaaataaccgaatattccgcccccaggggcgcatactagggaagcactgctcccaccctgtcacgcagggcgggccggtgcttcccttgcgtcataccaaggaatcaaggaggaatctcaccatgaacaagacccccaacaacagcatcaagtgctctgtgaacagttgtgcttaccactgcggcgagcagaactactgcaccctgaacgagatcaaggtgggttgctgcgactccaacgtgaccaactgcgcctccaccgagtgcgcctccttccagctgggcgaccacggcggctgctgcaagcgctgaaccgtccatccatgcaaaatcgcgcgttcccgattgggaacgcgcgatttttatggtatttactccttgggctcggcaggtacctcggccttagggtcggcagcggcctccgctgtaggcttctccgtagctggagccgcgggcttgacagcggcagccggggcggccttgggggccgcaggcttcacctcgggcaccttgccgtccacggtgatcagcttgcgggggcacttctgtgcgcagataccgcagccgatgcacttctcgtagtcgatcaccgccaggttgttgaccatggtgatggcttccttggggcagctcttagcacacagggagcaaccgatacagccattgtcgcataccttgcgggcgtccacgcccttgtcgtgggaggaacagggaatggtgacgtggcgcttggtcttgtagggctccagggcgatgatgtgtcgggggcagatgtccacgcacttattgcacgccttgcacttctcctcatcgaccctggccacgccgtcgatgacgtggatagcgtcaaagggacatgccttctcacaggagcccaggcccaggcagccataggcgcagcccaggtcgccgccgccgggcagcttggaggccgccacgcagtcgtggatgcccacgtaagtgtactgcttgtagttctggccgcagccggtgcagtgcacctgggcaatctgcttcactgcggcgccagcggacacgcccataatctcgccgatctgggcggccaccgcctcgccgccggcggcgcaggcattgactggggccactcccttgaccacagcggaggcatagccggagcagccgggatagccgcagccgccgcagttggcgccgggcagacagcccaggatggcctcttcacggggatccacctcaacagcgaacaccttggaggcgatcgccaggaccaggccgaagatggcgcccagcacagccaggaccacaacggcaattataacagtcgtcatattcttccgccctccttaaccgaagaccttcaggccggagaagcccatgaaagccagagcgatgaggccggcggccaccagggcgatcgggaagccctcgaaagccttgggccactcggagaactccatccgctcccggatgctggcgaagatcacgatgaccagcaggaagccgatgccgccggtaacgccgtacacgacgctctcaataaagccgtagccgttctgggtgttctgcagcaccacgcccagcacagcgcagttggtggtgatcaggggcaggtacacacccagggcctcatagagggagggcatggccttcttgaggaacatctcgatgaactgcaccagagaggcgatgaccaggatgtaggtcacggtctgcatgaaggtcaggcccatgggaaccagaatgagctcattgatgggccaacagatggcggaggccaggcccatgacgaagataaccgccagccccatgccggaggcagtctcgatctttttggaaacacccatgaaggggcagatgcccaggaactgggccacaataaagttattgaccaggatggcgcccagggcgatggtaaagagctgagtccactccattacttggccacctcctcagtctttttgtcgcccttcttgggcttgttcagaatgtactgcatggccgcgatcacgcaggccagggtcaggaagccgcccaccgggagaatcatgcccagagcgggaatgccctcgggcaggatgcggatgcctgcggcagtgcccaggccgaagaccaactgtccttctgcgccgatctccagcaggccgcccataatggtgccatttccaaggaactcgcgaaccacacacatgatgaccagcaccatggtgtaacccaggccctggaagataccgtccagcgcagaagcgccgataccattcttgtaggcaaaggactcggcgcggcccagaatgatacagttcaccacgatcagggggataaacaggcccaagctcttggacagggccgggataaatgcctgcaggcacaggtcaacgatggtaacaaagccggcgatgaccacgatgaagcaggcgatgcggatgttgttggggatgatcttacgcagggccgcgatgatgatgttggacagggtcagaatcaccaacacggacaggcccatgcccaggccgttgaacagggtggtggtaatggccatcaccgagcacatgcccagcagttggacggtgacggggttctggaagaacaagccgtccctaaattgtttcatcacgttcatattcgattaccctccttagcccatgctcgcggcggcggcgatggcgctggtgacggcctcgcaaacgccgcgggaggtgatggtagcgccggtcagggcgtcgatgtcgccgccgtccttggtgaccttgacctcgccggtcttgcccacgaactgggcctggaagtccggcttgctggcgttggagcccaggccggaggtctcgccggtgctggtaatagagatgccggagcaggccccggtattgtccacacccaccatgatagtcaggttgccgctgaaggacgtggcgggcttaacctccaccacgtatccggcatcgccggccttgtagacggcctgcaccatagcgtcgccgccggtgtactccacctcgtcatagctgtcggcggggagcacggcagccatggcctcctgggtggtcttctcgttgttagccgcgataaagggggcggtcacatagttggtcaggcccagcagaagggcggtggccgcacagatggcaaagaggacgatcaccagggtcgccatgcctggttcctttttcttggttgcagtctcactcatggcttagccctccttcccggcttttttggccgccttggccgcaaccttcatttccttggtcactccgtagcggccgggcttgcccaccttgtcgatgagccacacgcagcagttcatgatcaggatggagtagctcacgccctcgggatagccgccgaaatagcggatgaacacggtcagcaggccgcagccgatgccgaagatgatctcaccctttttggtgacggggctggtgacatagtcggtggccatgaagaaggcacccaggaacaggccgccggtgaagagctggtaggtcatccacaccagccggtcgttgccgcccagggggaacaggaaggtgagcaccgccacggtggcgatgtaggccacggggatgcgggcgcggatgacgccgcggacgatcagatacacgccgcccagcagcagggccagggcggagatctcaccgatacagccgcccacattgcccacaaatgtgtcgaggatggtggcatcgggcagcaggccgccgtgcatgaagtcagcagacaagggggttgcgctgctgacgatatccaccccggccatagtcttggtgccgcccagcaggtcggcccaggcgccggtgccgatgccgggggccacccaggtggtcatggccacggggtagcacagcatcaggaaggcgcggccgcccagggcggggttcatgaagttcttacccaggccgccgaagagctgcttgaccaccacgatggcgaagaagtcgccgatgatcagcatccaatagggcagggtgggggcgcacacgaaggccagcagcacgccggtgacggcggcggacaggtccttgacggcgcaggacttgtgcatcagcttgcggtagccccactcgaagaactcgcaggccagcacggagatgatggtggccaccaaggcacgggggccgaagaacaccacgcccatgaccatggcaggtaccagggcgatgagcacgtcccgcatcaggttggtggtgtcaatgggagaggccacgtggggggacgacgccaccgtgagtctcagcttcttttcctcgttcatgctttggccgcctccttcgccgctttttccttggccgccagagcccgcagctcacccttggtcacacggaaggactggaccaggtggaggcgggcggggcagatgtagttgcaggaaccgcactcaatgcagtccatgacgttaagcgcctcggcctccttccacatgcccttctcggcgtacaggtgcatgtagaccggagtcaggtgcatggggcagacgttgacgcagcggccgcagcgcaggcagacctcctcctccacaacgggggcggcctcctttttggtcaggcagagcacggcattggtgcccttgatgcaggtgacatccaggttatactgggcgatgcccatcatggggccgccggtgagcacgcggtcgggctcctccttgaagcccttgccctcgtcgatgatctgctggaaggaggtgcccaggggcaccagcaggtttttgggctccttgatggcgtcgccggtgacggtgaggatgcggtgggtcaggggcttgccctccaccacggcgtcgtacacggcagcggcggtccccacattgaacaccgcgcagcccacatgggcgggcagcccgccgggaggcacctcgcggccggtgacgcgctgaatgagctgcttttccgcgccctgggggtagcgggtgcgcagagactccacctgcacgtcgttcttgccgcccaccagcgccttcaggtgctcgatggcgtcctccttgttggcctccacaccgatgacggcgttcttcaggccgaaggcctgcatcagaatgcgcacgccgccgatgacccgctcgccctgctccagcatcagccggtggtcagcggttatgtagggctcacactcggcgccgttcaggatcagggtatccaccttgccgacgccggagctgatcttcacgtgggtggggaagccggcgccgcccattccggtgatgcccgcctccttgacaatctccacgatctcctcgcagctcagcttgctgtagtcgggatggggggtgagcacggagccccaggtgtcctggaagtcattctcgatgaccaccgacatcacctttccgccgcccacgtagggacggggctccaccgccttgaccacaccggacacagacgcgtgaatgggggcgcccaggccggcgatctcgccgatcttctggcccaccttgacctgatcgcccacggctacaatgggcttacagggcgcaccgacatgcattgccatggcgatgacgacctgcttgggagcggcgctcaggggcgcaacctccttgtggcgtgccaactctttccggtcattggggtgcacgccgccgtaaaagctttgcttcataggtccacctcgcaaatctgacccacacacgggccattgttctgagtcgtttgaccggtatctcaaacagatttatcatagcgcaaaccaagcatcttgtccagttaaaacgctcaaattcccttcattttttcttttaaaccaattagttttttctctttttccagaaatatggtaacatccgcagtaccatttttgcaaaaaccatccggtttactttttcgtcaggatgacaacagagctccgctccgttctccactttcgttgtttaaaatggagaagttcaaaaagtgaaattaacccaattgacaaatgcggtccggaacggtatgatatcaggtaattacattttccgggcttgcccggagcgtacaaaggcgatgaccgggacagtacgggcggtacataagcgcagagagggagcggctggtgtaagctcccatgaggccgccccgaacgctcgcccgggagcagccctgctgaaccgcaggttaggcagggacggtttcccctccgttagcggggcaatgagtgcgcgggcgcgccccgcgaagttaggtggtaccacggagtcatggcggcttcgtcctatgggacgaggccgccatgtttttttgcgatttataaaggaggttcggacgccctatgagaatgaaaaccgcccagattttgatggagtgccttctggagcagggggtggacacggtcttcggctaccccggcggcacgatcctgaacgtatacgacgaatttgagctccacggctacaaggacaaaatccgccatatcctcaccgcccacgagcagggcgcctcccacgccgccgacggctatgcccgcgccaccggaaaggtgggggtgtgcttcgccacctccggccccggggccaccaacctgaccaccggcatcgccacggcctactacgactcctcccctgtggtgttcatcacctgcaacgtcagcgagaacctcatcggcaaggactcctttcaggaggtggacatcaccggtatctccatgcccatcaccaagtgcaactatctggtgaaggaccccggcgccctggccgacgtgctgcgggaggccttcgccatcgcccgctccggccgccccggccccgtgctggtggacatcgccaagaacgtcaccgccgccgaggccgattacgagcccctccccctcgaccagcacgccaaccacggccggctgggggccatgctccgccgggccagccacgatctcaagactcccgagcccgacgcgggggacattcagaccctgctggatctcattgagggggcccggaagcccctggtgctggtgggcggcggggtcatccgctccaagggagctgtgccccagttccgcacctttatcgagcggctcaacgctccggtggcctccaccatcatgggcggcggcgcctgccccggcaatcaccggctgttcaccggcatgatcggtatgcacggctcccacgcctccaatctcgcctccgaccagtgcgatctgctcatcgccgtcggctgccgcttctccgaccgggtggccaccgaccccgccaccttcgcacccaacgccaaaatcgtccacatcgacatcgaccgggcggagatcgacaagaacgtgctcacccaccaccacatcatcggcgacgcccgccgggtgctggagctgctcaacgagaagctcccccagcacgactacccggagtggaaggcgtgggtgttctcccacccggaggtgcccctcaagaaagacgatgttctccacccccacgagattctggagaccatccaggccgtcaccggcggggacgccatcgtggccaccgatgtgggccagcatcagatgtggtgcgcccagtactaccacttctcccgccccggccagttcatcacctccggcggcttcggcaccatgggcttcggcctgggggccgccatgggggccgccgtgggcaatccgggcaaggtggtggtgcactgcaccggcgacggctgcttccgcatgaactgccacgagctctgcaccgccgagcactacaacatccccgtcatcaccgtcatcttcaacaaccgcaccctgggtatggtgcgccagtggcagaacctgatctaccagaagcggttctcccagaccgatctggaccggggccccgacttcgtcaagctggcggaggcctacggcatccagggggagcgggccgccacccagccggagttcgaggcggccttccgccgggccgtggccgcgggccggccctatctcatcgagtgcgccatcgacaaggacgccatggtccaccccatggtctccgccggcgctccggtcaccgattttattctggattaaaggagggcgtggatatgaatgaagccaatgtgacccgccgcaccctctcggtgttggtggaaaatgccgccggtgtcctgtcccaagtctcccggctgttctcccggaagggctataacattgaatccctggcggtgggcaccaccgacgacccagccgtgtcccgcatcaccatcgaggtgtgggccgacaagcccatgatcgagcagatcatgaaccagctgcgcaagcagttctccgtctactccgtgcaggagctgctgcccgagcggtccatccgccgggagctggtcatgttcaaggtgcgggccgagacccccgacatccgcaacgagatcatccagatcgccaacatcttccgggcctcgatcatcgacgtgtccctcaagtccctcaccctggccctgatcggcgacgagaccaaggccgacgccatgcagaagctgctggaggccttcggcatcctggagctggtgcgcaccggcatggtggccctcgaacggggcgcctataccatcggcgacgagaccaaggaacagaccgagtttaatctgggcaagaacttcttgtaactccggctggtccgttcctgcgagcgcagcgagccgccgctctgcggcgtccaagcgtttcgcgtagcgaaaccttgccgcaggggcaattcacttgccccgaggatgtgaattcccgcccgaagggctcccaaacgcgtcggcgcgtttgggacatgcagaccgagtttaatctgggcaagaacttcctgtaaagctcctgtttcccggtgcacagaacataggccccggcaaattccacagaggcctctgtgtttttatatcaaatatgaagtgtctcattttccacagaaagggggaaagcatgtatgaagcggtatgaaaccatgttcctgtcaaccaaagggagggtgttcctctattagccctccagatatgaaggaggaaatatgaaccatattaccctgcaaaaagtggatgaatccaactttcttgcgtgcttttccctgaaattagaggcccagcaggagaaattcgtatcccacccgatccggagtctggcccaggcgtatgtatactacagtcagtgtacgccctttgcggtctgccgcgccggtcaggtggtcggatatctgatggtcatctatgactatgacgaagaggcttacttcatctggcatctgatgatcgacgcccagcaccagggcaggggctgcgggagggcggctatggaggcggcgcttgcctatatccgttccaagcctttcggggcttccaacctcgtccggctgaccgtcagcccggaaaacgcggccgcctgccatttgtaccagaccctgcgcttctctcccaccggccgggcggacggggatgagatcgagctggagcgggtgcttgactgacctccgccccatgcggcggccttccgcttctgcggattgtatcacagttatcattcttttcccgaaaactatgctatcatgagttcaaattcccccaccaacaagaagaaaaaggagtgtatcaccatggctaagatgtactacgagaaggactgcgagctctcctacctgaacggcaagaaaatcgccatcatcggctacggctcccagggccacgcccacgccctcaacctgaaggactccgggtgcgatgtgtgcgtcggcctgcgggccggctccaagaactgggccgaggcggagaaggccggcctggcggtcaagactgtggccgaggccgcccagtggggcgacattgtaatgatgctcatcaacgacgaggtccaggcagaggtctataagaatgacattgccccctacctgaccgagggcaaggccctggccttcgcccacggcttcaacatccgctatcagcagatcgtcccccccgccggcgtggacgtgttcatggcggcccccaagggccccggccacaccgtccgttccacctacgtcaacggcaagggcgtgccctgcctcgtggcggtggagcagaacgccaccggcaacgcctataagctcgccctggcctacatcgcgggcatcggcggcgcccgggccggcgtgatggagaccaccttccacgacgagaccgagaccgacctgttcggcgagcagaccgtgctgtgcggcggcgtggtggatctgatgcgctgcggctttgaggtgctggtggaggccggctatgagccggagaacgcttacttcgagtgcatccacgagatgaagctgatcatcgacctgatcaacaagggcggcgtggcggccatgaactactccatctccgacaccgctgagttcggtgagtacgtctccggcccccgtgtcatcccccacgaggagaccaaggcccgcatgcgcgccgtgctctccgacattcaggacggcaccttcgccggcaagtggatcgccgagaacaagaacggccgcaccttcttcaactccaagcgcgcccagctcaagaagcaccagatggagctggtgggcgatgagctgcgccgcaacatgatctggggcggtgataaagatctggacactgcctccaactgacccagaaccgggcgcgagccccgcgcagcgggtcgcgtccggagcggaggcgcaagggagcgcagcgagggatgcccgcaagggtgtcccgagcagagtggactttgcgccgacgaggggcggcgacaaggatctcgacaccgccttcaactgaaccggggctcccgcgcaaccccagcgtcagcggtttgcgtggggaagcggaaccttcccttctccccaaaaagtccggcccgtgcatttgcacgggccggactttttgtttctgattcagcgaatgtctccgggaagccccgccgcgtcccgcgcggcatcgtagtccctcttgttcacatagatgatgtactcgtactgtgcccccgacgacatgcccatggtaccgaagtcggcccgggtacccggattgagggcggaaggcgagttgcggtcgatcgccttcaccgtgtagtccaaccccgcatcccgcagggcggacaagatatcgctctgttcctgcatggtcagaacggtgaccagctcgcggcggttccaaatggcaagcatacgttcccctccttctgctctttcccggtcagcccgagcgccctgtcctgtaagtcagggtgcttttgaattcaatgcagaatcccgtggagaaaaatctttgtcagcgtatctacaatctcctcatccccgtactggggttctactcccaccacaattttatactgaatcgcaaacccaaacagggagcccacataggtcttagaggccagataggtgtccaccccctcttggagattgccggtatacctcttcagcaccgtctctacacagcgggccacatagccgatgccgttcttatgatagatgctgctgacctccgggtgccgcttggagtcccggatgatggcccgggtaaaggcgatacgctccggcgtgtcaaaaaccgccagataggccagccctatctttttgatagcagcctccaaatcatagccgtctatttccggctgaatgctcaaaaaattgaaatagaacggtgtctcctgcatgacagcggagtagagctcctctttgtccttgaaatactggtagagtgtggccttggaatagcccgactccctggccagcatatccatagataccccgtcatagccgtgttccccaaaaaggatcagcgccgtctgaagaattgaggtgcggttggcgttatatgcatcctgcaacgcctcttcttccgaaatgtccagattttcaaacagatcctttttcccattgaagtgcaggtagatggtggacggggagatcccagccgcccgggcgatactgttaatggttgtccctttgtagccctctttcaggaaaatacatctggctgtctccaaaatcttttccctgacatcgctctccatgcttctccccctcctttcaaatttaactgttgattctagtttatcctgttataaatatcctgtcaagcatcactgtgcctccaattctgtattccgcacaagtttcccgccaactttttgtccaaaacatctattttgttttttttctgcagcgataatataataacacttgacagtatattattattatgctactcttgtattgtgtaataattattaccgactatttcaattatattattcctcaaagggaggtctttctttgatccgcattgatctggaaaatcacttttacgctccatgtctcattgacgcgctggcgcagcgcagtcagccgccgttttatgaccgcgccactgaccagattcactggaccgaggatgtctgtatgccccagggggagctgcttcagcggcttctggaagtaggcgagcatcgcctgtccctactggagcagcaggggattacccatgcggtgctgagctgttcccccggcgccgagcagcttgagcccgccaagagcatagccgtttgccaggccaccaatgccgcgctgtatgagctgacgcgggcccatcccggccgtctgttcggcagcgccattctccccgtaaaggacgtggctgctgcggagcgggagctggagcgctgtgtgaaggaatatggctttgtgtcatggcacacccactctaattacggaaacaccgcaccggacgatccccgctatctccccctcttccgcaaggccgccgaacttggcgtctacgtctatctccaccctcagctccccgagggtagccgctacgcaggctacggctttacctttgccggtcccggtcttggctttacggtggatacggtcaccacgctgctgcgcatggtggtatccggcctgttcgacgagattccctctctccggctggtactgggacacctgggcgaggggcttccctttttgctggaccgtattgaaaaccggatcaaatttctgcccaatccggccattcgctgccgccgcccgctgcgctactactttcagcacaacatctgggttactaccagcggcaatatgtcgccggaggctttccgctgtacccaggatgtgctgggtatggaccacattctctttgcaagcgactacccctatgagtccgtggaggacatgatggcctttttgcgcgggattccgctgaatgaggcggactacgccaggctctactatcaaaacgcagaagcattactgggaatttccctttcttaattgatttggaggtgtcatccatgaggaacaggaaacatgacggcaacaagtcctcggtcgtaaacttcggtgtgcagggctgggtcaccatcctgtactgtctgctgatgttctggctttatgccggcatggtgaacagcggttccaatgtaaccgccccggccatcgcagagaagttcggcatccttcccggtaccgtactgaatatgaacaccgtggccggcgtggtgggcgtcatcttctttattgtcgtaggccagatcaaccgggtgatcggcgcccgcatcacctccggcgtgtgcctaattgtcgccggcctggcctatctcggcgtaggcaatgccgtcaatcttgccatgtataccgtctgcatgtgtattgtggtgggcggcgtcatgtctgcgggctacatctccggcggggatctggtcacccagtggttccccaagaaaaaaggcatcgtcatgggctacaccaccatgggccacaatctggcctccgtcgcctttgtcccccttatcacacttctggtaggtcggctgggcattggcaacggtgtaattcccatctccgtttgcgccatcgtgcttggcattcttggtctgcttctcgtccgcaatactccgcaggagcgcggcctcaacccggacaatgtgtccgatgaggtctaccgaaccgagtacttccacggccatgaggatcccactggcggctggaccaccggcagactgctgtggtgcaaggaaacctggctggtggccgtcaccaccggcatgttccaaatctgctccctgggcgtggtatctcaaatggtgctgcgcaacatggagctgggcttctcccgggagcaggccacctttatcctcagcctggtagctctcatcggcctggtcggctccttttttgtgggctatatggatgagcgccttggcaccaaaaagtccatgctgttcttcggcatctggtacgccctctccctgctggccaacgccaccgagaacaccgttctggtctatgtctccatctttatgatcggcatgtccattggtggctccgccaacttcaccacctcccttaccacctccgtgtttggccgtcagggattcagcaaggtaaattccgtcgttttccccatccaaggcgcggtgtccgccctctccttcgtggtcaacggcgtagtctccaacatcaccggcggcaacctgcgctacacctatctcatttttgccggcgtatccgtagtctccgcgctcattgtactgctagtggatgaacaccgcttcaacaaggactggcagcagggacagaacgcccgctccgcctcttgatgagtccaataaaaaagatcgcctgccccggccggggcaggcgatcacagtttttggggtcattccacgcttttcagcagctcctccgccgaaactccgaagagcttggccagggccagcaggttggaggtgctgggatcggcggtgccgctctcccacttgctcaccgcctgacggctcacgcccagggactccgccacgaactcctgggtcatcttgcagcgggtgcggtgataccggatggcctcccccaggctcctggccatctccgccttctcctgccggacgggaccggatttcaggtacttccgcagggccttaatgagcagaaccgccagataaatcaccagggccaggatgcccgcccagatcaccagccccagtaaaagtgggattgtcgtcgcgaaactcatatcaaacactcctttccagatggccccattttagcctgtttgggcggttgcctccaccaattatggcgcaacttttggttgctcttcccgctcttcccgctcctcccgctcccgcgcggcccgctgggccaggattttggggaagaagtggaggaacaggcaggtggtcactgtggcggccaccgcgtcggcgataggctcggagaggaaggtggcctccggggagaccagggcgggcagcaggagcagacccgccaggaacacgcacttgcggaagatggagcagaacagggccagccgcacgtggcccagggcagtggtctcgtccaccaggggatactggatggccagggggatgatcatggcggtgaataccttaatgtagcgtaccgaccgcgccgccacctccgggttctgggtaaacaggcccacaaacaccggggacagggtgtgggtcaccaccgtcatgagcacacagaaggtcacgcacagagccacgatggactggatggccctcttgatgcgctccaggttggccgcgccgtagttgaagctgaccaccggctggctgcccagggtaaggccgcccatgggcatggtgatgaggagcagatagctctgcacgatggtggcgcaggtcaccagggtatcccccagctccggcccgccgtagcgctggagcacagtgttcagcacgatcagcaggatgctgtccgtggcgatgatgaggaagggggacaggccgaaggccagcacccgccgcatgatgcgccaggagaagccgccccaccgcaggcgtaccggcatccgtttccgccgcagggagcagaggacgaaggcgcaggaggccatctgggagagcacggtggccagggcggccccggccacgtccagatggagcacaaagataaagatggggtccaggacgatattgagcaccgcccccagcatcaccgtggccatgcccaggccggaaaagccctgggcaatcaaaaagctgttcatgccggtggccatgagggcaaagaaggtgcccgcggtgtagatggtcaggtaggtgttggcgtagccgaaggtggcgtcgctggcgccgaaccacatgagcagatgctccttcagcaggaggaacagagtggtcagcacgccggacagtatcagcagcatcaggaagctgttggacagcacccgcccggcctccctgtccctcccctcccccatgcgcatggccatgatgggggagccgcccaggcccaccagggaggcgaaggaggacagcagggtgacgatggggccgcacacccccacccccgccagggccagatcgccgatgccctggatattgccgatgtagatgcggtctacaatgctgtataggacgctgaccagctgagccagcatcgtggggatggccagccggcacaccagccggaagaccggatcacgccccagatcgttggtctttctcacggtttttcctccctttttgaaacacactggggcattatacctctttttccgtcccccgtaaagtccctttagttttttagcactctcgaacgaagagtgctaacatttacaatttagacatatttacatgtatatttgttcataaactcggcctatactttgtctcagaaaacgagttaaggggccggaaaggcccccggaaagaggatgatttggatggaactaaggaagttttagcatatcaatgttcctactgctaaatcacatttccgagaaaaggagcgatttttatgtttggcatgcttccctttgagcgcagcgacgacaacctgtttgatacctttgataactttacccgcaacttcttccgcggcagcaacgccagcctgcccgccttccgcaccgacattcgggacgccggagacaagtttgtcttagaagccgagctgcccgggttcgacaagggcgacatcaagctggatgtgaaggacggtatcctcactattaccgccgagcacagcgagaaccaggagcagaaggacgccaagggtgcctacatccgccgggagcgccggtacggctccttcagccgttcctttgatatcaccggcatcgatgagggctccattaccgccgcttacaacaacggcattctggagctgaacctgcccaaggccgtccccgtggttcctgagagccgccggattgccattgattgacctggatatccgggagccggtcagccttggctgaccggctccttcccgttttctgttccctcccagcgctcgcagccgaagtccggctccgggtgccgccgccaggggtgaatacaatgaccgtaccagagagggtaataattcccctgctccgtgcggacgtagtgctggcggtaatgaacgcaggtcccgcagacccgcttttccaccatgtacttccggggcaatgacataaaatcacctcatattgttatattactatcattcgatagtatagtcaatactattatccggtagtaagatacaatagcgccgaggtgaataacatgtatcttccccggctgcgcgatttgcgcgaggatcacgatatgacccaggcgcagatcgctgcgattcttggaatcgaccaaagagtttacagtatttatgaaaccgggaaacgggatatacccctgccccatctggtaacattagctgactattataaagtctccacagattacctgttgggtcgggagaaatcctgattctccttataaaaggagcgtgacgcaatatgaacgcgcagaaatatacccagaaatccctggaggcggtgcagaacgcccagtccatcgccaccgagtacggcaaccagcagattgagcagccccacctgctgctggccctgctgctggacgagggcgggctgatcccccagctgctggggaacatgggcctcaccgtcccctccttcaccgccgccgccaaggcggaggtggaaaagctgccccgggtgtccggctccggccgggagcagggcaagatctatgtggcccaggacgtggacaagtgcctcaacaccgccgagagcatcgccgcgtccatgaaggacgagtatgtgtcggtggagcacctgctgctggccctgctggacacggccaaccgggagctgaaggagctgttccgcacctacaacgtacagaaggagggcgtgctccaggccctgaccaacgtgcggggcaaccagcgtgtgacctccgacaacccggaggagacctacaacgccctgaagaagtacggctccgacctggtggagcgggccagggccaacaagctggatccggtcatcggccgggacgacgaaatccgcaacgtcatccgtatcctgagccgcaagagcaagaacaacccggtgctcatcggcgagcccggcgtgggcaagaccgccatcgccgaggggctggcccagcggatcgtcaagggggacgtacccgcctccctgaaggacaagaccatcttcgccctggacatgggttccctgatcgccggggccaagtaccgcggcgagtttgaggagcggctgaaggccgttctcaacgaggtcaaaaagtccgagggccgcatcatcctctttatcgacgagctgcacaccatcgtgggcgcgggcaagaccgagggcgccatggacgcgggcaacctgctcaagcccctgctggcccggggcgagctgcactgcatcggcgccaccaccctcaacgagtaccgccagtatatcgagaaggacgccgccctggagcggcgcttccagcccgtcatggtctccgagcccacggtggaggacaccatcgccatcctccgcggcctgaaggagcggtacgaggtgtaccacggcgtcaagatccaggacggcgccatcatcgccgccgccaccctgtccaaccgctatatcaccgaccgcttcctccccgacaaggccatcgacctcatcgacgaggcctgcgccatgatccgcaccgagatcgactccatgcccaccgagctggacgtcatccagcggaagatcatccagcacgagattgaggaggccgccctcaagaaggaggacgacgccttgtccagggagcatctggccgagatccagaaggagctggccgagatgcgggacgagtttaacgccaagaaggcccagtgggaaaacgagaagaacgccatcggcaaggtgcagaagctccgggaggagctggagagcgccaacgccgagctggaggccgcccagcggcagtacgatctgaaccgcgccgccgagctccagtacggccgcatccccgagctgcggaaacagctggaggccgaggaggccatcgccaacgagggtaaggcccgttccctgctgcgggacaaggtcaccgaggaggagatcgcccgcatcatcgagcgctggacgggcatccctgtggccaagctgatggagggggagcgggaaaagctgctccacctggaggacatcctccaccagcgggtggtgggccaggacgaggctgtgcgcctggtgagcgaggctattctccgctcccgggcgggcatcgccgatcccgaccgtcccatcggctccttcctgttcctgggccccaccggcgtgggcaagaccgagctggccaaggccctggccgaggccctgttcgacagcgagaagaacctggtgcgcatcgacatgagcgagtatatggagaagttctccgtctcccgcctcatcggcgcgcctcccggatacgtgggctatgaggagggcggccagctcaccgaggccgtccgccgccacccctactccgtggtgctcttcgacgaggtggagaaggcccaccccgacgtgttcaacatattactccaggtattggacgacggccggattaccgacagtcaaggccgaaccgtggatttcaagaacaccattatcatcctcacctccaacctggggtcccagtacctgctggacggcatcgataagaagggcgacatcaccgccgaggcgaaaaatgccgtcaacgatctgctgcaccactccttccggcccgagttcctcaaccggctggacgagattgtgttctacaagcccctcaccaaggacaacatcacccacatcatcgatctgctggtggccgagctcaaccgccgcctggaggataagcagctcaaggtggccctcaccccggcggccaagcagcacatcatcgacagcgcctacgacccggccttcggcgcccgtcccctgcgccgcttcgtgcagcacagtgtggagaccctcatcagccggaagatcatcgccgacgaggtgcagggcggcgacaccctcaccgtggactgccgggatggcgagctgacggtggaaagcaagagcgtcctcaccggcgaggtggtcaatccgtaaacagacagccccggccgcttgcggccggggctgtctcgttccctttcgccggctagaccgcccgcccggcggccagcatctccttacaggcccgaatgtccgcctcgcccagcggggtgaagcggcccagggcggaggcgtagtaggccacctgggccgcctcctccacataggcggcggcggtcatggccgcgggcaggtcccggccgcagcagaggctgccgtgattgcgcagcagcacggccagcccgtccgtccccagggcggcggccactgaggcggccagcgcccgggagccgggcaccgcgaagggcaccacccggatgggggcgaactccgcctggggcggcgtggaggggggcagctcatccaccgccatggccatcacggtacagaacagggcgtggttatgcaccaccgcccccacgtcggggcgggcgcggtagaccgccgtgtgcatgggggtctcggaggagggcgcgtagggcccatccacccactccccgtccagggtgacaatggcgatgtcccccggctccatggtgtcatagggccgcccgctgggggtgatggcggccacccccgcctcccggtcccgcacggagatattgcctgatgtcccgtggatcagcccctgagcgctggcctgccggatggcggtgagcacctgccgccggatgtcctcatacttcatgaaagcgtccccttctctctgtggtatctgccctattatagcacaaaaaacggtctgagtcatctgactcagaccgtttgcgcctgcatatgggaaaggcggaccgcccggcgggcctggagctcccggaccgccggctcctccagcatcagccgtttcccattttccagggccaccacccggccctccacccgggagaccttgtcggtgttcaaaatcaggccgcccgggcagatcagaaactggggctcgccgtccagcagcagggccatggcctgaaagcccagccgggcccggacgcggtcgtaggcggtgtagagcagcagggtctgcttctgcgcctgaatgtagtggatatcatcggtacggagcgggtgcttaatgggcagaatggcatcccgcgcgtggcggggagccagcgcgaaatagtccgtcatgacggtgttcatgccgctcacccgccgccactccacagcgccgaaggtgtcggccgcggtcagcaccttggcccgcagggcctgtccctcctccagataggcccagagggtctccccctctccgcgggtgcgccgcagctcctccgccgccctccactggcgctcgccgccgcggaggcagactaattgatatccaccgctctgcgccgccatggcgaactcctccaggcagtcgaagcagtcggtcaccacggcgaccttccagcgcaccgcataggaaaacatctgctcccggagctgctgccggtccttctcctgtggtgcgatcaaggcaattctgatgatgttcaccctctctctgcgccgcagaaagcccccctgaaccaatccgggtcaaggttcaggggggcttttgagcgattagtctacgccgccgatcaggccgagggcctcggcgatatccaggttgacgcccagaacgttcaccgtctcctcaccgaagatgcccagcaccttgccggtggtgttgtccgccacgaactgctccaactgctcctcggtcaggccggtgttctccgccaactgcggaatctgcacagccgcagaggcagggctgatgtggggatccaggccggaaccggaggccgtcaccaggtcggtggggatgtcctccaccgtcaggtcaggatgctccgccaggaattcgtcgatgtcgccctgcacgcgctccgccagagcggggttggacgcgccgtagttgttggagccggaggccacgccggcgtactcgctgccgtcgttgtagaacttgttgccctcctcatccaccgtataggtgttgtactggtaagcggaggggcggcagcgcatgaagcgggggtcagtgaagtcctggcccacgttcttggcgcccacggcctggccgtccacatagatgatgctgccgttggcctggctggggaagagcgcctggctcataagcgtcatgacaacagggtagatcaggccgcagatcagcagcagtaccagggtcaccagaaccggcgctctgagagatttgatcactttcatgttcggtttcctcctgttacattgccatgccgaggccgagcatcgtcagcaggggcgcgatgatcaggtcgatcactttgatgccgatgaaggggacgatgacgccgcccaggccgtagatgagcatgttgcgggtcagcatcttgctggcgctcatgggcttgtacttgacgccgcgcatggccagcgggatcaggcaggggatgatgatggcgttgaagatcagagcggacagaatggcactggtgggagaggccagcttcatgatgttcagcacctgcatctggggaatcaccatcataaacatggcggggatgatggcgaagtacttggcgatgtcgttggcgatggagaaggtggtcagggagccgcgggtgatgagcagctgcttgccgatctccacaacctcgaggatcttggtggggtcggagtccagatccaccatgttggccgcctccttggcggcggtggtgccggagttcatggccaggcccacgtcggcctgggccagagcgggggcgtcgttggtgccgtcgccggtcatggcgacgatcttgccctgagcctgctcctccttgatgaccttgatcttatcctcggggcggcactcggcgatgaagccgtccacgccggcctcctgggcgatggtcgccgcggtcagcgggttgtcgccggtgcacatgatggtcttgataccgatggcgcgcaggcgggcgaagcgctccaccaggccgtccttcacgatatccttcaggtagatgacacccagcacacgcttgcccacgcagacggtgaggggggtgccgccctgcttggacacctggtcggtgtggccctgcagatcggcgggcactgtgccgcccaggcccttgacgtactccacaatggcgtcgctggcgcccttgcggatggaggtgccgtcggccagatccacgccgctcatgcgggtcttggcggtgaactcgatgaactcggcgcccttcaggctgctctcgtccaccacgacgccccgctccttggccagggcaaccacgctcttgccctcgggggtggcgtcgctcagggaggagagggccgcgtacttggtgagctcctccacgctgatgccgctgacggggatgaagtcggcggccatgcggttgccgtaagtaatggtgccggtcttgtcgaggatcatggtgtccacgtcgccgcaggcctcgacggccttaccggacatggcgatgacattgaagcgggtgacgcggtccatgccggcgatgccgatggcggagagcagagctccaatggtggtggggatcagacacaccgccagggcgatcagggtggacacgggcagggtgactccgctgtaacggccgatggggtacagggtgacgatgacgatcatgaagatgatggtcagggccaccagcaggatctgcagggcgatctcgttgggggtcttcttgcgggaggcgccctccaccagggcgatcatcttgtccaggaaggactcgccggggttagaggtgatgcggatcttcagccagtcggacaccacggtggtgccgccggtgacggaagcgaagtcgccgccggactcgcggagcacgggggcggactcgccggtgatggcggactcatccacgctggcggtgccctcgatgacctcgccgtcgttggggatgatctcaccggcgctgaccatgaccacgtcgcccttcttcagctcgctggaggagacgacggtctccgtgccgtcggccttgagcagacgggccttggtgtccttctgggtcttcttcaggctctcggcctgggccttgccgcggccctcagccaccgcctcggcgaagttggcgaagaggacggtgacaaagaggatgacgcagacaaagatgttgtacaggcggacattgttgatgccgtcggtgggcccgaagagctcggggaagatggagagcagcagagcgatgacaaagccgatctcaaccacaaacatgaccggattgtgcatcatatatttggggttcagcttggtgaacgccccgataacagaggacttgaagatgtcctttgttacgaatttggtccgatgcttatctttcatagggaatccgtaatcctcctttaaaccggcagccagatggacagatgctcagcgatggggccgagagccagggccgggaagaacgtcagcgccgcaaagatgtagaccacgaaggccacgatgacgccgaagccgatgttgttggtcttcagggtgccgatggactcgttcatgcgcttcttgcacagcagagaccaggcgatggccagctggagcacgatggccaggtagcggccgaagaacatggccagaccggcggtgatgttccagaagtaggtgttgtcggccaggccctcaaagccagagccgttgttggcggcggaagaagagtactcgtacagcacctggctcaggccgtggaagccggggttggtgataccggcgcggccggcctcggtgccgacggccagggcggagaagcccaggatcagcagggggtggatgatgaggaccagcacggccatcttcatctcgcggccctccaccttcttgcccaggtactcgggggtacggccgatcatcaggccgcacaggaacacggccagcatgacgtacatgatcatgttcatcaggcccacgcccttgccgccgaacacgcagttgagcatcatgtgcagcaggggcaccatgccgcccaggggtgtcagggtgtcgtgcatgttgttgacggtgccggtggtgaaggatgtagtgacggtggtgaacagggcggactgggcgatgccgaagcggacctccttgccctccatgctgcccatggactggctcaggccaatctccgccagcttggggttgcccgccagctcagagaagtagcacaggcacaggcccaccacgaaaatgatgcccatggccacgaacacggtgcggccctcgccgccgaagatgggctggcggtcggtcaggcggcggcccacgacggggtgcgcctcatcagtcagcttcttgcggttgtggtgcatcaggccgaacatgatcacgcaggcgccgggcaggatcatcatgctcagcagctcggtaatgtcggagatgatggtggggttctccagcggggtggtggagttggcgcccaggaagccgccgccgttggtgcccaggtgcttgatggagaccaaggaggcgatggggcccatggcgatgtcctgctgggtgccctcgatggtggtcaccgtctggttggccatgaaattctggggagcgccctgccacaccaggatcagtgtcacgataatggagaaggggatcaggatgcgggtggtgatgcgcaccagatccacatagaagttgcccaggttgttcttgctggtgcccgtcaggccgcggcagaaagccacgcaggcggcgtagccggtggaggcggagacgaacatcatgaagatgatgaccagcatctgggagaggtagctcagcccactctcaccggagtagtgctgcaggttggtgttggtcatgaaggagataatggtgttgaaggagagggtgggctccatggcgccgatgccgttggggttgaagaccggcaggaactggatgcgcaggatcaggtagccgataaacaccatgacggcgttggtaagtaccagagccagggcgtattttttccagcccatgccctcattctgattgataccgcagatgcggtagattccattgtcgatgcggttgaacacggggtcgcaaaacgtatgttgaccagtggcgatgtggaacatatagcggccgatcgggatgatcagcagcacgaaaatcaccagggtcagaatgatttgcagcattgcaaaattcctcctctgtgcctcagaacttttccgggttggccagggcgtacaccagatagcacgccagcgcaataatgacgatacccaaagcaatcataactagcaattcctcttttctagcaaaacagtcttatttgtccatctggcggtcgcaccagtcggccaacagtttcaccaggacaaagctcacgaccagagtggctatcatagcgagatccattacttccatcttgtttccctccttgtgtccgtctccgcgtgctctccaccgccggagcggtgccggtcgtctcccgcggtccggacctgacgcgctgattcccaaccgccgggccgcagaaccccgcctctgcctccagcgattgcacgtatgagttttaccacgttccggaaagaaatcaagagctttttcacaatcttaattcagccttaacacatccgcatgttcccttatcctttctttttgttgtggtaatatttgtatttttagctttgtgggattcttatggattcttaacgccctccactctcctcttgcaccttcctaatccctttcgcgctatactgattctgtaaagagagtattcagcgcactgtgacacaccgctgcagagaggagtccttctgatgtatgcctatccagtccactcgtctgtccccgccccccgcaccgcagcccgagccagttggaaatcggccgccagtggctgcctcgcctgggggctgaagacccaccccattgtgaccggcacggcggtgcttgccctgagcggcgctgttcttgtgggcggcgtatctctggcggttctcgccgtcaatctgccgctctatctggccgccctcctgctgtgaggcttacggccagagctcaaaaaaggggccatcaccggagtgatggccccttttatggttctatgtctgtgtttatacggcggttggcagctccggccggttttcccctgccccacactgccacaggcttgcctgtccgtctgcctccatacaaagtttgggagcggcccctgcctcggagccgctcccgcggggtgagccctatccatatatcaagtcagaacgacttttttccactgcatagcatctgcatggagaaaagcgcctatcattcgccgtgccggtgcggcatgggctgtgctggcagacacagcccatgcctgcgccaaatcacaaagagaggtggtctctggatccacaaaacaaaaaagctgtacctccacgggtacagcaaacaaaccttatgatacctgtctcaatcataagcaactgcaccctccctggaccggggaggcttcctgtgcgtcatatacaggcaggtattctgactcaggcatccagcgcggttctcgccttcccagggcatagccccagtgacctataagaaccgctccaccaatacagcaacggcattgtgcgggattcacacccgcttcccttttcagcgtctccgggaggaggcgcacctgtataccattcagtattccattgtataggtagattatagtccctctttcttcccatgtcaagccatttccctcctttgcccgctggtgcgggcaaaggagggacggcctgacaccgccatgcccttactgccagtcggcagggtagacaaagtaggcgtagcgggtccggttgggggtctggaagtgaatgtggcttcccttggggatgtagatgatgtcgccggggcctccggacaccacacggccgtcgatctcgatctccagcgtgccgtccagaaccaggtcgtactcatcataggtgagggtccactcgaagctggtgtgatccagctccatgatgccgcagcccatgcggggggcctcctccagcgtcaccacgtccttgagcttgacgccgtcctgctggaagggctcgcacttgacggtgctggtcttgatgccgatgatcccgctgggatcgatgtgcttttcaaactcgggcttgctgcccttgcccgcggactcctccaaaaccttggtgacaatctcgcggatgagcgcttcgcttacattcatgatagattccttgcctttccggtattggccttactcgattacttggaaatggtctggatcttggagagcagcttgggggccaggaggttggccacaatcagggcggtgacaccggccaccagcttaccagcgatcatggggaagatcatctgggcatcgttgccggcggcaaagcccaggtggtcgccgaacacgaaggcggcggatacggcgaaggccacgttcaggatcttgcccttggggttcatctcgcccatgatgttgaacatggcgatgttgttggccagggtagccaccagaccggcggagcccttgtcattcatgcccagggcgccgcccagcttggacagggcgccgccgaaggtacgggtgatccactccaccatggggaaggcgccgatcagaacaatgccgatctggccgcagaccagcaggccgttgttcagcggagtcatgcccaggtcgggatccaccgtggacatcacatcgaacacggggaacatgatgccggtgatctgctggaacacggcgatggcagtcaggacggtgatgaccacggtgacgccggtgccgaacttgttgaagccgttgatcatgggaccgggggcgaaccacaggccgatgacgatcagggcggcgatgacgatgacgggcaccagattaatcaggatgcggccgatgtccatcttatagggggtcatgttcatgaccaggccgcccacgatgcagccgatggggatggtgatcataccggccaggacgccggcgcccaggtaggggcggtcttccttcttgatgatgcccagggccacagggatggtaaacacgatggtggggcccatcatggtgcccaggatcaggccggcgaagttaccgatggaggggtcgctggccagctccatagccagagggtagccgcccatgtcgcaggccagaatggtggtggcgaacatagaggcatcggcgccgatggcggtgtagatgggggagatgatggggcccagcaccatggacagcacgggggccgccgcatacacgccggccatggcgatggccaggccgccgatggcgttgaagccgtcctcaaacttctcgccgtagcccagcttattgccgcggatacggtcaatggcgcccacaatcatgaagatcatcatgatcagcatgatgacggagttgatgttcagtccggaaacccaggctttgatactctcagtaaaaatactggggtcagcagctgcgatcagttcgctaaaatccattacttacactccttctctaactctcaaaacagtttgggggttgaaggtctctcttctctttgcgcttacagcagggactggaatacctgctgcgcggggcgcgggatgacggaggtgcccaccagcagctccgcgtcacgggacgcagcggccacggcttcacgcaccgcccccacatccccggtcagggtgacaaagcccttgccgccgatggcgtatccaatgcgcacctcgatcagggtcacgttggctgccttggcggccacatcggcggccgtaatggccgaggcgatggaatagaactccagcacgcccaccgcgccgcctgcggggggctgggtggtcatgctgatagccggaatcagttggggatgcgcgttggggagcagcagcgtgttcaccacgctctcgccgccctggcggatgccctcggccatagaggccttgacgtcgccggtatcccctgcgatgatgataatgtacttgccgggacacacggtagaggaacggatgagctccacctgggctgcctttaccataaaatcactggtctcaatgccccgggcaatactggtcagctcgaccatgccgatggcgtttgccataccgttcatacctccttccggcagagcctggcgcccgccggagtgatttctgtcaccacgccgtcgatgctggcgtggatgttggcgctcaggccgtccggggcggcctgagccagaagctctccctttgccaccgggtcgcccacggccttgacaggcacggcaggcttgccgatgtgctgctggaacgggatgaataccgtctccggctccagggggatgcaggtgtgggcgtgcagaccatagtaggccgataggcccagccgggccaccagccggtcggtgggcgtcttgcgctcgtccacaaactcccgggcgtggggctccatgttccggggcacctgaatgccgcgcttgcgcagctcgcccttgatgtagccgttcaccttgcggggagacaggcccatggggcaggcgaacatctcgcacacgccgcagtcgcagcagttggccgcgtcgccgaaggagcgcagatactcctcgttgtcctcgatgctcccctcccgccacaggttgcgcatgaccaggttggggcggatctggtgcccgatgagatagcgggggcagagatcggtacacatgcggcactggatgcaggcgctcttggtctgatggcggatggtctccatcgggagctgggcccgccggaacaggtagtgctccttgggcaggacgatcaggtttccggtggtcttggtgaccacggccgcctcaatggcggcccggtcggtgaggggcttgcccatcatgggtccgcccacgatgagggcgtagtccgctaagttgggccgggcctccgccacgcaggccgtgagggccgtgcccaccgggacctttaggagaatgggctccttgacctcgcccaccacggagaggtatttctccgttaccggagttccctccagggcatcctggatgttgagcagggtgcctacgttgtccacgacgcagcccacgtccaggggcagcccccgctccgggacggagcggccggtcacctgctgcaccatggtctgctcgtcgccggccggatagaaggtcttcatccggaacagctccacctgggcgccgctccggctgatagccccctccagggccgtgatctccgcgtggtacttgcccttcagggcgatcaccgtgcgcttcgcgcccaggtgcccggccaccgccaccgcggcggccaccacccggtcggggaaggtacggcagagatatttgtcggtttcgatcagcggttcacactcggccgcgttgaccagaaagcactccgccttggctgagagctttacatgggtggggaacccggcgcctccggcgccgactacacccgcagccttgaccgcttcggtcagattcatgacgtatgaccattcctttcgcggaagtttccgccgggccgccgcggcgcctccccgtcaggggagcacgctgcggtcgatctcctggtcgtccacaatgccgaccacggtggcgtccaccgggatgctcatatcgccggcggcgctgcgggccgagctgcctccgaccacgagcacggtctcccccacgccggcgccgatgatatcggcggccacgatggggggccgttccgcttttcccgtcagcacatccagcggctgaaccagcagcagcttcaggcccgccagtttttcttccttacgggtggcccagatgttgccgatcacctttgctaccttcatagccttgatccatcctttttcgggtaatggggctcagggcccggggtcactcctgaaccagccggatcccgtgctccttggcgcagtccttggccagagccgtcaggatgcacttggcggggacatggatgcaggtgaccttttccgccgcggcgtcccggatgtcccgctccgtgagcacccgcttggtcacatggaccagcttctcctcacgagccgcggacatgggggcaggggcggagggttccgcggccgcgggcgcctccgccggagccgcctcacaggccgcgccgcccagcaggagtccctccaggttgtgtttggagcagaccaccacgccggaggtcaagagcagatccaggcgctccttcatcatggcgtagtaggccgccggggcggtggaggcgtagcggtagagctccacctcctcggtgggtacgtagacccgcttgcccgtcaggatggcctgggcggccaggcgggtatagggggtgtcgcacaggcccagggccagcttggcaagggcctcgttggtgagcccggtgagcacgaccacgccataggaatccaactcggccggctcactctggagggaagcgcagtccacacggaaccgcgccttcagcttctcgcacttcagcatggcccggcaggtgtcgttcatctcctggctgagcagcagcaggccctcccggtcatcccggtctgcggcggccggggcggcctcgcccccctccgcctccgccagcttggcggccacgcgggctacaatttcattgagcagcgtttgttccatggcttcccctcctttctgttcatgaatttaaggggtttattccagggtacagttcatggcgatgcctgtgggggtcacgagaaaggggttggccggcttgatcgtccggattcccgtcaccttctggaagatgtcctcgatgcccgtcaggcagcaggtgccgccgcagaggtaaatggtgtccgtgtgggccttgtccacatagcggctcacgatcgtggccatcttctccaccacggggcgcaccacggggaggatctcccggtggcgcttgtagtcctgcttgatggcctccgcctcctcgaaggagacgtgatagttgcccgacagaaccagggtcagatgggtgccgccggtgggctcgtcctcgatctgcaccaccttgccctcctttaatatagcaaggccggtggtgccgccgccgatgtccaccaccacgccgtcctcaatctgatagatggcgttggcggcgctgggctcgtccaggatgttggtcacctccaggccggcgccctccgccacatactggtgggtcttgacactggattcggtgcccgcgggcatggcgatggcgcagttgaccagctccgtgcccaggcgggcctccagcttttccttgagcgaccgtacaatgcgcagcgcgccggtgtagtccaccaccacgccgtcccgcagaacctgggccgcctgtttctcgcaggccacggggttgttttcctcgtccagcaccaccagcacaatgtaggcggtgcccagatccacgcccaccttgagccggcttcccaccggcttgaaggtggttttttcggattcctccacacgggcgaggtagttgtttacgcggtccaagtccatcatgtcgctggcgctccttctgttgattatcggatgatcttgccgaggataaagccgctcaccagagccgcgttggcctcgtccacgtcaatgtgcatcttacagctaaattccgtgctcacccggatgatgacatcctggaaaatcacgggccgctcgctcatcacggccacggacacccgctgcttgtctttcagatccagcagcttggagtccggcgcggtgacgtggatgtggttgtgggcgatgatcacgccctccttcagctccagcgtgccgcaggggccctcaatggtgatggccccggagccggccacgtcgccggactcccggacgggggccttgacccccagctccatgcagtcgctcttggacagctccacctgggtggccttgcgggccgggccaaggaccgccacgcgctccttccggcccttggggcccaccagtgtgacccgctgctcggacaggaactggcccggctgagagagcggccgcttgggctccagcctggcgccgggcccgaacagcacctccacgtcggcctgcgacagatgcacgtgccgcgcggagacctccacctcgaccagtcccgcccggtggaccgcatccatcactgcggatacgatttgttccatatgcctgttcctcctcagcggtactggcccgccaggtacatgcacatcatgatatgaatggcgctggacaggcggttgagttcctcgatgatatctttccgggtgtatttgttgcccacccggaaggcctcggtcgccgccacctccgtctcacggacggcggcgcggagctggttgagcagcgcataatccctgcccatggtgtaatcgggcagctgcatgtactgcacgccgaagaacttctgcggattgtgggaacgctcccgcagctcggcgtgggtgagaccaatgatggtctcgttcttgaacgcctcgtccagcacgtcgcagcgcatcatctcccggagaacgcccaggatgttccccaggtcgtccaccagcttctggcagccgccctcggcgatctgaacctgatccagcaccaccagggcctggaggctgtccagcttgccgcggaaatggatgcgggggtgatccttggccaccagcacgttgccgaacagctgggtcatatgctccggcttttccatgtagtaggcgccggtctcatagtccacgtacttgggcttgggcggctccggggcgcacatcacggtcgggacgaccggctgggcggccggggcggccgcgggggccggctccgccggctgcccccctgcggccactttgattttgcgctgctgaagatattcccgcgccgcgggcgtcagtattttcccctccgggatgtagtagacctcgggctgggtgttccgcagctccacccggaggaaatcttctgtaattgccttcacgcgctccaccccttcctatggttgatgggacacgggctacgcccgtatcttacttctccagggagggcaggatggactccacctcgttgtgggggcggggaatgacgtgcacggagatcagctcgcccacgcgctcggccgccgccgcgcccgcgtcggtggccgccttgaccgcgcccacgtcgccgcggaccatcacggtcaccaggccgccgcccacgtgctccttgccgatcagggtgacgttggccgccttgaccatggcgtcggccgcctcgatggaggccacgagacccttggtctcgatcatacccagagcttgcatcatattcataacagggacactcctttacttgtttgcgtcaggctgcctcagcccaggtggggcaggatggactccacttcctcgtggggacggggaatgacgtgcacggagatcagctcgcccacgcgctcggccgccgccgcgcccgcgtcggtggccgccttgaccgcgcccacgtcgccgcggaccattacggtcaccaggccgccgcccacgtgctccttgccgatcagggtgacgttggccgccttgaccatggcatcggccgcctcgatggaggccacgagacccttggtctcgatcatacccagagcttgcatcatattcgccatttgtgatccttcctttcacaggtaaaccgcgctgtacgcggatgagattgggttacagcttctggagcttaccgatgatctggcggacgatgtcgtccacatcgatgttctccagagagggagccgtgcggcagacgccgtcggagcagtccggcacggaggcgcggatctcgtccagctccttgaggccgtaggccacataccgcaggttgagcaggtgcatggggcccacgttctccgaggtggcggagccgcccacggcgccgcagcccagggtcagggcgggctggagggcggtggtgccgccgatgccgcccagggcgctgggggtgttcaccatcacgcgggaggcgggcacccggcgggcgaagtagtccaccatcttatcgtcgttggtgtgcatagagaaggtgtggcccgcgccttcgtagtggaggatctcacagaccttctcgcacaccttctcgtagttctcggcggtgtagaaggccaggatgggtcccagcttctcgttggaatagggatggccgcggcccacgccggtctccttggccaccagcacgcgggcggtggcgggaaccttctccaggccggccagattggcgatggtcttcacgctgcggcccacgatctcggggttcatggtgccattggcccgcagaatgaagcggcccagcttctcccgctcctcgtcgtccaggaagtaagccccctggcgctccatctcggccttgacggcgggcaccatgtcatcgtcgcagatgatggactgctcgctggcgcagatggtgccgttgtcaaaggtcttggagtccaggatgcgcttcactgccaggggcaggtcgcaggtcttctccaggtaggcggggccgttgccggggcccacgccgatggcgggggtaccggaggagtaggccgcccgcaccatggcggagccgccggtggccaggatcatggccacgtcgcggtggcgcatgaggttgtcggtggcctccatggtggggatggtgatgcaggagaccaggttctcattgccgcccgcctcggccaccgcctgccggatgaccttgacggtctccaggatgcagcgcagggccgtggggtggggggagaacacgatggcgttgcccgccttgatggcgatctccgccttgtaaagtgcggtggaagtggggttggtggaggggatcaggccggcgatcacgcccacgggcaccgcgatggtgcgcaggcgcttggcgtcgtcccggctgatctctccgatggttttcatatccttgatgtgctcgtagacaccgcggctggcaaagatgttcttgatcaccttgtcgtccacgatgccgaagccggtatcctcgttggccatctgggccagccggcgggcgttgcgcacacccgcgtcggcaatggcacgcacaatgcggtccacctgggcctggtccatccgggccagctcctgctgggcctccttggccgcctctaccagctcccgaacctcctgcatggacaggagatctttatcgattagctgcatacagttccattcctttcgctgaacttcatgccgggggcagtctcaaaccgcgaagcatgctcagttgttttgctccgccaggaacgccgtgattgccgcgagaagctcttccttcttggcaaaccggatctccttgcgcgtcatgctggtcaggccgatctgtctggccacggcccgcagttttaccaccgccatatgctccagctcctccgtggtcaggctggcgggctccatcaccgcgccatcgctctcctgctcctccggctccagcggctcaccctcctccggctccggctcaggggccggggcgggaggcgtggggggaaccggctggtctggttcggcggggatgtgtcccaggatttcttccagctcctcatggggtctggggatcacgtggacggaaatcagggttcccacccgttccgccgctgcggcaccggcgtctgtggccgccttgacggcgcccacatcccctcggaccatgatggtcaccaggccgccgcccacatgctccttgcactggagggtgacgttggcagccttgaccatggcatcggccgcctcaatggaggcgaccaggccgcgggtttcaatcatacccaatgccttcatatgtacctccgttcatgggcccgtgcgggcccggtcgctctgccggtcagaccttgggctggtcggcgacggactcgacggcggcggcgaaggcgtcacaggcggacttgcaggcggactggctgccggtcagcagggcgccgccaaagttggtctcagacgggggggcgtacagcacgcacatccgcacgtcggcggccttcagcgcggcatccacgccgtacatggcctccaggggaggcgcaatcaggtaggcaatggcctcgccttcggcaatgccgcagccctcggacaggtaggagccggtgcgggagatgcagtgggcatagtagcagatgctgtcgtcgtcattggcggagacaaagtggcacacattctcgatcatgtccacgcaggcctccaggccggccttggcctcggcggggttgggcgcggccaggatgccgatgatctcgccggccagcttggtgttggcgttggcggcgccggcgtagaagctcttggcgtagacaaccttgcagtcggccttcttggtggcctcgtccagggcggtgtaggtcacatcgtcgctgtcggcagtaacgatggccagggacttctggtcaggggtcaggcccagctccttcgccatgtcgggagccacgttggggataatgcgagtcgccagtacatgtgcgggcaacggatcgcgtttcatattgattttcctccctgctcttacagtttcagatcggtaccgctggccttcttatccagcatgatcttgatgatttccgcgatgtgggcgccggcctcggcggggatggtgccggcccggtggatgttggacaccacggtgcggcgggcctcaggcatgcccacggtggccttgtaggcgatgtaagcggacatggactcggcggtgatcaggccgggacgctcgccgatcagggtgcaggtgacggtggcgccggtcagctcggagatctcatccatgacgcccacgcggccatacttcacgaagaagggggtgcccacgtcgatcttgtagctctccaggccctgcaggatggcgggcagcagatcgccgatgttggcagccacggcggcggaggacaggccgtccgccacgtagatctgaacggtggggttcttcttgcacttggccttgatggtttccacggcctcggggctgagcttgcggcccagatcggggcgggtcagataggtgtccttgctgtcgcactgggtctgcaccgtccacaggcccatcttctccacgaactcggcgtccacgtcgttaaacacggcgtcctgggcggcggagtgggcggcgcggaactccagctggggcagggtgttgtagcgggcgccggccttgccgatgcccagacggcagggagcgttcatcttcagctcggcatactcctcgccgttctcagggttctttaccagatactgcttgcgaatgtcgatctccgtgatgtcggggatgcagccgtcctcaacctccggcgcagactcacacgcacaagcggcagcggccttctcggcgggcttggcgccggacacattcatttccgtcagcacctgctcaatgatgcttctcagatctttctcgtccattcttcgctcctccttacttcttcaggaacacggaagcgtcgccggccttgggcgtcagcttgccattctcagagaagcccatcttctccagccacatgtcgaactcgtggatggggcgcaggccaaagacctcgcgcagggcagcagcctcatggtagccggtgcactggtacatcagcatgcagtcgtcgccctcgggcacgcccatgatgtagttgcagccggcggccaccagcagggtcgccaggttctcgatgtcgttctggtcggccttcatgtggttggtgtagcaggcgtcgcagcccatggggatgccggtcagcttgcccatgaagtgatcctccaggccggcgcgggtgacctgcttggaatcgtacaggtactcgggcccgatgaagccgacgacggtgttgaccaggaaggggttgtagcgcttggcaaagccatagcagcgggcctccatggtgacctggtcccagccgttgtgggcctcggaggaaagctcagagccctggccggtctcaaagtacatgacgttgggtccggtgcaggtgccgcgggacagcatggtggcgcggccctcgtccagcatggcggcgttcaggccgaaggcctcgttgcccttctgagagccggcgatggactggaacatcaggtcgaggggagctccgaacttgttggcggcctcggtctgggtggtcacgtgggccagcacacagatctgggtgggaacctcccacttgcgcttgaactcgtcgaacatcttcaggatgcgggccacgctctccacggagtcgtccacggggttcaggccgatgacggcgtcgccgcagcccagggacaggccctccatcacggacgcgatgatgccattgggatcatcggtggtgtggttgggctgcagacgggaggagaaggtgccgggcagaccgatggtggtgttgcagtgggcggtcacgcgcatcttcttggcggcgtagatgaggtccaggttgctcatcagcttacacacgccggcaacgatctcagaggtcaggccgcgggaggcccggcggatcatgtcgggggtggtctgggtatccagcagccactcgcggaactcggccaccgtcatattcttatactcgttaaagatggtctcgttgacagaatcctggatgatccgggtcacctcgtcctcctcataggggacggcggggcagttgcgcagatcgttcagggtcagattggagagcaccaccttggcggccactctctcctctgcggtttcggcggcaatgcctgccagcttgtcgccggatttttcctcgtttgccttcgccatgacttcccgaatcgatttgaactcgtacacatggccgaacagctttgtcttcaggatcatgctagttcacctctcataagtcctaacattaagaattgaaaatcaaggtcttgatcactacgggcagcacctgcccgcctgcaatgggctcgccgatatcgatgtagtcgccgctcagggtgcggataccgtcaatgcagatgacgtccttctcccgcttgagcagtacgttcagcgcgtttccgagcacctttccgatatcgttctccaccaccacgaccaagggatacctgctgctgatcacctccttcgtgctctcaatgatagctgccgccaatgcctgaatgtccgcaaagctggtgcgcttttctccggtaaaagcgatcgcaagctgctccgcttttccctcaggcatatacagcggcatctgattcaaaatggaagccttcagcgtttccagcgacgcctcgtcttcctcggacaccttaagaatggggacatttttcagggggagcgtgccctgctcatagtggatggtgctcccgctgacctcggtggtatgggttcccgcccctaccacggtggcccggatggtctcgatggaggtaaagcgctccacccggctcagatccgggtcggcccgaatggcctttcccaggaggacgccgatgtcgccgaagcgaaacacgtcgccctccatctcctgatagatgcagtccgccacgccgccggagtaggtcaccgcgcggatggccggctgctccggcagaggcttgccgttgttggtataaaggccggcgtggtggctgtccgcccccgccaggcggagggcctgggccagttgggccgccatgaggcggcacacgccgtagagctgctcgggataggcccggtcgcccaccgccagcgagattccgttggcggcggccagggcctggatcttggggaaaatgtagctgatgcggccgttttccaccttgatgagccgcccgccgatgtcgaggcagcaggtcccccgcagcacgcccttctcatagacggcgatgttgctggtcccgccgccgatgtccacattggcgatggccgtgcgcttttccttggacagggcgtcggtgcccgccccccgggcggagagtaccgactccagatccggtccggcggtggccaccacgaagtctccggccaggtcggacagagcctccagcacctcgttggcgttctccttccgggcggtttcgccggtgatgatcaccgcacccgtgcggagcatctccggcgtcatgccggccgcctggtactcctcccgcacaatccgtttgaccgcctccgcgtcgatctccgtggccgaacgcaggggcgtaaagtagatcttgctgcggtagatcacctctttatccacaatgtcgatgcgcggcacggtgtagctgctggcccggttttcgatggtcagccggctgaaaatgagctgggtcgtcgaggtgccgatatcgatgcccacgctgaggatcacttcatgcaacttgcttcacccgcttcctgagagttcaatgcaaaacggagcccgggtacagagaatccctctgtatccgagctccgtcgctcgtctgttccagccgtcgttacgtcacgtcggccgttccgatgatctgatttttaaagtcgaatctggcgcaggttccctcggggcccgactcgatctccaggttgccccgcagcttgtccttcaccaacgtctgcacgatggacagccccaggcggttgccctccgtgttggccacatcgaatccgcctccgttgtcgctgacctggatgctggagtacagcttcccctgctccacgacgatccgaatctctccggaagagcggtcctggaaggcgtacttcagggagttctgaagcagttcgttgatgatgatggccaccgacgtggcgatgtcggagtccacctgaaagtccccgccctccatggtaatggtgacatagcatttggggttggaaaaataccgcatggtattgttctttatgttcaggatgacctcccccagcatgacctcgtccacaccgctctgggccagcagctcgtgggtgctggcaatggagaggatccggttcatgctctcccccagcacctgccgcgtctcctcgctgtcggtgcggcgcgtctgcaggcgcaggaggctggcaatggtctggaggttgttcttcacccggtggtggatctccttgatggccacagacttgagaatcagcgcctgctcctgctcccgccgccaggtcacatcctgaatgatcacggcgaaggccgcccccgccgagttgagctggatgtgcttgatgtccagcaccaggttgctcaccgtagtctccacataggagtagccgctgcactcctcgctgttgccgtcctgttccaccaggcggacgttctcatagggctgtcccaggatgtcctcaatgtagcccagcctccggtacagatcctgggccagggagttgcggaaggtcacgatgccgctgcggtccaccatgaggagtgcctcgtcgatacactcggtgagccagttgttctccggcaccatctgagccagggcgtgggcgatggtctcaaagctctgctgcgagaaatgaatccgctcactgacctgcctctgctcgtccacccgcttctccaggatcagcacgccgatgatatgggagccgttgcggatgggctctaccgactggatcgtgctcccattctcctgggtcacggccttcatctgcttggttcctacccccaggcggaaggtgcgggccaccgccggctcgttctccggcttggccagcagtcccacaaccgtgttcttgtaggacgacggtacgcattccggtttggcctccgccaccacgatggcgttcccgtcccgtccggggcagtcgatgaagatgtccgcaccctccagattggccagaggctgcagcgtctctgacatgtgctcaatgatgcggatctcttcatcggacagatcggtatactttctgcagagggaccaaatcacattcacctgtcaacccccgcctttcacgaggatcatctctgccacccggcgcatggaaaggcccttgagctgactgagcttgcgtatatagtggtacgcctcctgctccgacaggttctgctcctgcatcacctgtcccttggctttttcaatgatgctgcggttggccagccgctcggaaaccttggccatgtccttgcgcagccgtttcatctccttgctctgggccacaaccagctcgatgttgggaatcagcgacttctcgtcgatgggcttgaccagatagccgctgacgccgtaatccttggcctgctccacgaactcccgctcactatacgccgtgagcataatgatcgtgtccgccagctcctcctcatagatgatcttggccgcggccagtccgtccagaaacggcatcttgatgtcgagcagaacgagatccggatggtagagcttgcagttctccacggcatcaaacccgtcggagacctctgcaacaaccgtatacccgccttccgtaagcagttctttcaaatccattctgctgatcggctcatcgtctgcaatgacgacacggatcgcatccttttccatgcggctcctcctgacttcaaaggaaatccagatgccttaccaaggcttccacgccctcgcccgtcacgctgctgacgacaaagatctcacccgcgccggctgccttcaaatactgcctcgcatttgaaatctcatgctcagacgccagatccgactttgtcacaacccccacgcagggctttgcaaacatgctgctgtaggcgggcgggaacatgctccccttctcggtggcgtcctggaccagcacaatcgtgtccgcgtcggcggccgtcaccatgagggccccgcgaaaatagcgccgctccagatactcgcccggtgtgtcaatcatactctggttgacaatctgtacggtctgggtcttgtggtactgcagttcctcgtggttgatccgctggcaaagcgttgttttgccggccgtggagcggccgatcaggataatgcgtctttttctctccattgcatcacgtcttggtgatgggggccgatgcaaagcccatcataccgcacagggtattcataacctccgtcagcgccgactgtaccgccgccacatcgccggtgatgaccaacgagccgttgaagcggtccacaaagccgatggacacgttggccgacttggtggccacatcggcggcgatcatggccgcctcactgggggtgatggtaaagatcccaatggcgccggaggcgtcgatcagtcccagcttcaggtacagatcctcggtggggtttgcgatcacatgggccagggtgacctgcttgccgggtacaaattcctgtataatccgctttttctcatcaagctcaatcaaatcggcacactcctcctaaaaaccgctggaaacagcgggctgtcccccctatcatgccacagggccgggcagcctatcctgcgtaaacgcgctgcggtgttttccgcaacaccggcagggggttcacaggcgtacggggcgaaaaaacaaaaaaagcccccagaatttcaagtcaaaattcttgggagctacatcgctcttgatcgtttaccaggcgagccgtactaacgccgcacgaatccgcccttccactatacgcatctctatcattttttctggctcattttaacagaaatttgcggagttgtcaatccgaaatatcattttacgccaaattcctccgccgcgcaattgcgcggcggaggagctctgtcagggcaatttcccgctgtaggccttgcggaagatctgttcaatttcctccgccgtgcagcttctggggttcgtggcggtgcagcggtcggccagggccgcctccgccatgtcgtgcaccgcctcctcgaactccgccgcgttcacgcccgcggcctggagggtggagggcatgttcagcttttcgatgtaccgccgggcggtgcgaatgaggttgagggcgctctggcggacactgctgctctccagctccagcaggcgggaaatacgggcatagcgcttggcggtggaggtgagctgttcggcgcagccggcgttgaagctcatcacatagggcagcaggatgccgttggcccggccatgggggatgtggaaccgggcgcccagggcgtgggccatgccgtggttgaggcccaggccggagttggagaaggcgatgcccgccaggcaggaggcgttgtgcatcccctgccgggccttgcggtcctcggggttctgataggcgggcagcaggtggcgcttgaccagcttgatggccttttccgccgccgcgtcggagaagtcggaggcctcggtggacacaaaggcctccaccgcatgggtgaacacgtcgatgccggtgtccgccgtcacggtagggggcacgctggtggtcagctccgcgtccaaaatggcgatgtcgggcagcaggctgtcctccaccaagggatatttgacccccttctcctggtcggtgatcaccgcaaagcggctcacctccgagccggtgccgctggtggtggggatggcgatgaacttgcagtcccgcatgtcccgctcccgggcggcgaagaacacgattgccttggccgcgtcgatggcggagccgccgccgaaggccaccaccgcatcgggctggaactccaggatctgctccacgcctctggtgacggtggcgatgtccgggtcggcctgcacgtcggaaaagatcttgaactcgccgccgctgcgcagcagccggtcggtgacataattcgttttgccgctctcggccatgaacttgtccgtcaccagaaagacccggtgcagccgctgggccagcgcgtccatgccacctccgatcataatttttgtacgaacactgaaggcgtccatatgctgctcctttctgccggtagaaatacaaaaagcgccctgaaccgtggttcaggacgctgcatcgcttccaaaagccctgccgcttcctcgcagcatggccagtctcactttaccccatggcgcagccctctgtcaagccttttcttccgccagggctcaatttttttcgttcggcaaactgcgggttgactttcgcggcaaatgctgacataatggggctcgtcaaagcaggtgcgcatggaaccgtctggttccgcccggcacgggctcccccgtgcccccgcgggcgctgtccagccagccccgccccctgcgccggcctccggcgcggcaagtaaatagactctctgtttcacagaaaggaatcggttttgatggatatcagattcgttctcccttctgaagtggagcagctggcccggaatgtggtgacctcattcccctccaagacgccggccgccctgctccagaacatggaaggcgaactgcaccgtccggacgagggccgttacctcggctgttttgacgacgatggaaccctgctgggctccatcctgatgatggatttcaccctcaacgtcagaggtgtgatgatgcctatgggggccgcagcctatgtctccgcaaactttcttcacaagaaagagcgggtagcctgcacgctcctgaaggtgttgatgcggtattacgccaaacaggggacgccgatcggctgtctccaccccttcaatcccgcgttctatgccaacatgggatacggttactgcaacgagaactatctctaccagcccaagccctccgcgatccgctcctacggcgacaagtccgggctgtcctatgcccggccggaggaccggcaggagattttggacttctaccgcgcctatgcggcgcgtacccacggtgccacggtccaccactacatggacccccaccggatcttcgacatgccctacgtggtggtctgccgccgggacggccggctcaccggctacttcaccttcgatttcgtggcggtggaccactacaccgacatgtaccacgatctgctcgtgcccgagatggtgtatgaggatctggacacgttgcggcagttcatgacctttttcgcctcccaggtggatcagatcgagcgggtgcgtatcctctcccccgaccccagcctgaccatgctgttccacaacccggacacaggcgagaaccgcgcgcacgacggctgcatccatgaggtggcccgccgcacgatgggctacatggcccgtatcttcgatgtgccggcctacttccgcatgcagagccgctgtgagtccccggtcagccgtccctttgtgctggccctccaggtggatgacaactttatcgagggcaacaacggcaccttcctgctgaatatatccggaagcacggtggaggtggttgagcatgctcagcccgacgtcaccctttccgccgatatctccaccctctcttccctggtgatgggcgctttctctctggacgaggcccttcgcctgggccgcctgaccctctccgaccacggctacgctgccgacgtgcagcgcgccatcggctggagccggaagcccgcgaacttcacctatttctgatcctgtccgtgcaagcacagcaaggccggggcggcttctgccgccccggcctgtttttgtccctcaccgctccagaaaggcggccagcgccacatcgtactccggcagcccattggccgcccacagcagctcgatgcccagctcctgccgggccagcgccgccagatcaaagccgaacgcggaaaaggagtagcgcatccgccccggattccggcagggcagcccgtcccgccgggcgcagcgggtgcatagctcgcaccgccccgccgcgatggtccacgccccgctccgggtctgctccagcgccagaagggtttccagcagtacccgcttggctggtccataggacgcccggcgcaccgcctcagccccctccgccgtggacacctcccggcgcgtctgtgcatcataaaatacctgcatgcccagcacatgggccgtccgaaaaggccgcagggcctccgccgccgacggtacccccggcgggcaggaccaatcgtttccgtagtccgggcaggcccggcaggcctcccggaatcgctccgggaagcagtattcccccagcaggcgctccaccgggagctccgccgccgttatcctggtctgatacatttaaccgcccccatcggcgttttctctgcgtcctattatagcgcattttccgccaaatgggaactcctgttttccgcccggccggatattctgtaggggtggggcttgtccccgcccgcgggcggccataaaggccgcccctacatttccggggttcgatttccggcaggctatctcacggcgcttgtatgtaggggcgggtacccacacccgcccggggctggccggtggcccggaaagacgtgcctatgtgggcatcggcccatacaaagcaggacttacccccgcctgtccccgtacgtctccacccgtaggggcggcccttgtggccgcccgcggcagggacaagcccgcccctacaagccgtccagcagacaagatccccgcgtccggcggtatgccgggcgcgggggtgcccctatctccagagggggtaataagaatggcaaattatacggagcattatcaattacatcaatgggaaccggaggacagctttctccgcaccgacttcaacgaggacttcgccaaaattgacggggcgctgggcgggaaggcagaacagtctgcggtggatacgcttgccgagcaggttgccgggaaatccgagctggtaacggggagctataccggagacggggaggccagccgcaccattgagctgggtttttcccccaaggcggtactgctggcctccggttccgggccgatcaattacaccagctcgcgttatggcggtctggccctggagggggcagaggtaaacacggactgggaatccacctccggcgagccggttctccgcgtcgttacagggggattccaggtattctacgattatgacgaggaggttttctccaactccgaccgtgaccgctatcactacctggctttgcgctgagaaaaagaaaaacccccgtgctttagcgcacggggggtttccgcccacagggtaaattctgattggattactcggacacgctaaaagtgatagtgatgtccacgccgtccacagtcagagtagcagtcgcagtctcgtcaccgtcaaagacgccggcatcggccagagccttgaccagagtgttagcgttgtcgccagtggtcagacctttgtcgctggaatcataccagttgctgccctggaggccgccgtccttatcccacacataggtcacaccgtcatacacgatggtggtagcaccgttcttgtgcagggagcccaggaagcgggcagtatcccaagtaatggcattggactcggtactaatggcggactgctcaaaggaggcagtcaccttggtgccgtcggagttccaggtgccgtgggcaacatagttacccaggtcgccgttctgtccccaagcgccatccgcattcaccacggcatcagagacggcctcctcaacctcagccacggtctcgtcggtgataacgctgttgtcctcgtccacatagacctcaatcacagcgtcgccatcgtaaacagcggagatcacacccttgaagttgtcgtcctcatagtcgcgggccagacggctgggagtggtggtcttgccggtgccgccatcgtttaggaagatggtgtactcgtcggccagaaccaaatccacaccgtcgaaggacagcacgccggaggagtaggcgatcgtggagtcgacgttccagacgcgcaggtcgttgccggagacggcgttgttgatgcggttcagatcgctggtgttgacatagccgtcagcgtcgtaggtcacattaccgtacaggccaacctccacatcactggtgctgttcaggttgacagtgccgatctcgccgttgacaatagcgtcaaagacatagtacttgttatcgtcggcatcctggctggactcgtaatcggtgtccaggatgtagatgcggtcacccgccacgctgccggacacgcccagctcgccagtctcaccgttgatgaacaggtagtcggcatagccgttgtcgtccaagatcgcaacgacctcaacctcggcatcggactccaggtgggtgatgttcacgtcgggcacgttgcggatgccagtgtagacattcacgttgtcgccgcggcggatcacgaacacggtgtcgttattcaggcggacgctcttgtccagagaaatacgggcatcgccggtttcaatgatcttgccggtagtattaaagtccttgctagcggaatcattgctgttcagcttgcccagctcataggtgccgtcgttcttctcgtcataggagaaccaggtgttcttggtcttgtcgctgctctcccactcaaggtcatcggcgttagaaacctcgatgacagcggtggtgccgtccacgaagtaggccttagcctcaaagctcttgttaacgccgccgatctgagcgacattggtgatgaacacgtagtcgttggaagcctccacgccgtcagcgtagatgacatagccgtaagtatccaggaccagatcgtagtcatccttcaggttgtaggtgctgctgtagccctggctgtactcgtacttggtgccgtcaagcgtgacgttcttattggaggtgtaggaggtcacagtgccggagacgacttcggcagcctgaatggtcttgacctcgtcgcccacagcggtgatcaggacataatcgccgtcctcaaatgcggacaggttttcaaagtcgtcggcggacagggtggtattgacagcggggaaggtatccaggcccagatcatccagctccagctcctcgttctcctcgtcgtagccgccgtccacctgagccacataggtgtgaatctgagacaggatgacgttgttgtcgtcgtccacaaacacctgggtcaggacgcccttggcagtgcccttggcgtcgtcggtttcgttgttcacaaagtagtcggccacgtcagggctgctgaccggatcgccatccacgtaaacagaaaaatcagtgggcttagaagcggtgatatcgttgtagacggtgcggccaatcacgtcatacagatcgcccttgtccacagcggtagtaaaggttccgtcagcctcagcaggataagtgccgatgatgtcgttcttcagcttccactggctggcggggcgggcaaagtcgtcctcaccgttgacctttttcagatctgcgaagtaacgctcacagaactgctgggtatcgtcgttgctgtcgccggcatagtcgctgtcggtcttggagacaggttcagcggcagtgttgcccacgatgatggtggagccgtcaggctgctggatagtggtgccgcggctggcgtagcgcaccatgtcggcctccagggtctggtaggccatctgggcagcctgctcacgggtcatggcatcggccatgattacaccggacacggcgataccggcatccacggcatcggcggccacattgacggcccagtcgttgcccacatactgctcgatagcgggatcatagcccagggccaccagcagcatcttggcaaacgccagtccggtcagctcaccctcgggattgaaggtgccgttgcctgtgcccgccagaatattctgctgggcgcagtagccgatgtagccggcagaccagcggtcggcagccacatcgctgaacacagtggagttagtggtcaggttctcggcatcgtcgcccaggagcatgcggcagatgatggccgcagcctgctcacgggtcagaatgccggtaggatcaaaggcgcccttgtcggtgccctcgaacacgccgagcgcggtcatgacttccgcggcctcggcgtaagtgatctcgttgccgtcgacgaaatcactgctcgcagcgggggcgccgacgaccatcataccgacgagcatgacagcggccagaaccaggctgagagtccgcttgaggtttctcatttggatttcctccttctgaattttgaagcctaggggcgtatgacgccccttacatgggaggaaagaatgcagctttcggggaataggggtataaaaggcggggaaacagaatcaaaaggttcgcatggtagacgtatggtagacattataaaaaactccttggggaaaaagctgaaaattcaggcgctttgcgttgcattttggtagacatttggtagacataaccccacgcacgatcagaagaggtataaaagtcggcagattgggtattttgaaagcaaaggatcacaggcacgagaagagaaaatcggagcacacgagaattttgctttgattttaaggagagatctgctataatgtactcgtattggagcgcacttccatggaaggcgtttattaaattgtgtttaccgggccggtgaattgccggcccttggataccgtttatgccggaaacggctgcggcggaaggaatagagggttgtagctttgacaaaatatgtgatccacggcggaaagccgctttttggagaaattgacatcagcggcgcgaagaatgccgccgtcgccataatccccgccgccctgctggtggacggggtatgccgcattgagaacattccccagatcagcgacgtgacattgattctgaatattttgcaggagctgggcgccgatgtgcgcaccgtcaaccgcaccacggtggacgtggactgctcccacatccgcaacgcccgtgtgcctgaggagctggcgcggaaaatccgcgcctcttattacctcattggggcgctgctgggccggttcggctccgccgaggtgccccctccgggtggctgtgacttcggcggacggcccattgaccagcacatcaagggctttgtggccatgggggccgacgtggatgtgcggggcggctacatccatgccaaggccaaaaacggccgcatgtgcggcacccagatctatctggacatcgtctcggtgggcgccaccatgaacatcatgctggcggccgtgctggccgacggcctgactgtcattgagaacgccgccaaggagccccacatcgtggatctggccaacttcctcaactccatgggcgcggagatcatgggcgcgggcaccgacgtgatcaagatccgcggggtggagcgcctgtccggcggcagctactccattatccctgaccagattgaggcgggcacttatatgaccgccgtggccgctgccgggggcgaggtgctcatccgcaatgtcatccccaagcatctggagtgcatcaccgccaagctgctggagatgggggtggatgtggaggagcgggacgacgcggtgctggtgcgccggcacggcaagctgacccgcaccaacgtcaagaccctgccctaccccggcttccccaccgacatgcagccccagattgccgccgtcctctgcctggcggagggcaccagcgtgctcaccgagggcgtgtgggacaaccgctaccgctatgtggacgagttccggcggatgggcgcccagatccaggtggacggcaagatcgccgtcatcgagggcgtggagaagctcaccggcgcccgtatccaggcctgcgatctgcgggccggggcggccatggtaatcgcgggcctggcggcccagggcaccaccgaaattggctgcatccaccacatcgagcggggctacgaggatatcgtgcgcaagctctccggcgtgggggcggacatccgcgtggtggtcaccccggacgaggagaagcagagtcaggtaggctaaaaagaaaacagggagcggcggcgcaggccgccgcccttttttgcgcagagagactacatagtgaggagcgattccgtgctggaactttgtaccctggccagcggctccagcggcaacagcctgctggtgaccgacggccgcacccatgtgctggtggacgcgggcatctcctgccgccgtatctgcaccggcctgaaggagctgggcgtggagccaacggagctcgccggcgtgctgatcacccacgagcacagcgaccacatctccggtttgaccaccctgaccaagcagctcaggctgccggtgtatgccagcccggggacggggcggcagctttgctaccgcatcgcctttctggaggagctgctccgccccgtggcgccgggggagggcttttccatcggcgggctggcgattgagagcttccccacctcccacgacgcggcggagagcgtgggctacgccctgtccgccggggggcggaaggcggcggtggtcaccgacctgggctatgtgaccggggcggtgctccgcggcatccggggggcggatctcctggtggccgaggccaaccacgacgtggagtgggtgcagtccggcccttacccttatcacctcaaggcccgcattctgggcgaccggggccacctgtccaacgaggcgggggccgagctggcctggacggcggtggaggggggcgcccgcacggtggtgctggcccacctgtcccatgagaacaacacccccgcccgggcccacgaggtggtacggggcgtactggagcgccggggcgcggcggtgggccgggacgtggcgctggaggtggccccccgcagcgagaagagccggaggtacacggtatgaagggcatccgggtgcagctcatctgcgtgggcaagatgagggagaaattttacatcgacgcggcggcggagtacgtcaagcgcctgtcggcctactgtaagctccaggtggtggagctgccggaggagcggctgccgtccaatccctcccaggcccagatcgacgccgccctggagaaggaggcggcggccatccgcgccaagctggctccgggggccagcctggtcgccctgtgcgtggaggggcgcatgcgctccagcgaggaactctccggcctcctgtccgactggagcagccgggggggaagcagcctgtccttcctcatcggcggctcctacggcctgcacgcctccctcaaagcggaggcgtgggccaggctgtccatgtcccccatgacctttccccaccatctggcccgggtgatgctgctggagcagctctaccgcagcttcaagatcgacgaaggctccagctaccacaagtaggcgtgacaatctcccaaattcgtcaaaagacgggctggatattggtaaatttttgtgctataatcacagtgcagtacattgtttacgccagaatttcagatattggaggttagtcccatgtcctatcgtgatgtttatgaaaagtggctcagcagttctgcactcagcgaggcggaaaaggaggagctgcgctctatttccggcgacgagaaggagattgagagccggttctttgccccgctggagttcggcaccgccggtctgcgcggcaccatgtgcgtcggcctgcaccagatgaacatccacgtcatccgccacgccacccaggccttcgccgaggtcattctggccgagggccccgaggcggtgaagcgcggcgtggcggtgtgcttcgactgccgcaaccactcccaggagttcgcccgtgagaccgccggcgtcatggcgggcaacggcatccccgtacgtatcttcgagtccctccgccccacccccgagctgtccttcgccgtccgggagtatggctgcatcgccggcgtaaacgttactgccagccacaaccccaaggaatataacggctacaaggtctactggcaggacggcgcccagctccccccccaccacgccgaggccatcgccaagaagatggaggagctggacttcttcgcctccatcaagcgcatggactacgacgaggcggtggagaagggcctgatcaccgtcatgggggctgagaccgacgagaagttcctctccaacgtcatggggcaggtcaacgacaaggccgcagtggagaaggtggccgacaccttcaagatggtttacacccccttccacggcaccggctacaagctcatccccgaggccctgcgccgtttgggcatgaagcacgtcatctgtgtccccgagcagatggtcatcgacggcaatttccccaccgtgatctcccccaacccggagaacccggagggcttctatctggctgtggatctggccaagaaggagggggcggactttatcctcggctccgaccccgacgccgaccgggtgggcatcatggtgcgcacctccgacggggagttcaaggtgctcaccggcaaccagaccggcgtgctgctgctggactacctgatcggggcaaagcagcgcaccggcaagatgcccgccaaccccgtggctctcaagaccatcgttaccaccgagatggcccgcaaggtcgccgagaccaacggcctgaaaagctacgacacctttaccggcttcaagttcctggcggagaagaaggacaagctggagaacgccggggagggcaaggtgatcttcgcctacgaggagagctacggctacatgctgggcgactatgtccgcgacaaggatgccgtcaccgccgccctgtccctcaccgagatggcggcctggtacgccggacagggcatgaccctgtatgacgccctgctggcctgctatgagaagtacggctattacggtgaaaagactctgaacctggtgatgcccggcctggacggcctgaaaaagatggccgatctgatggccaatctgcgggaaaagcccccggtggagatcgccggtgtgggcgtgctccagcagaaggactacaaggacggaagcgtggtcaacgtcgccgacggcgcgaagagcaccatggagctgtccggctccaacgtgctgcgctatgagatggccgacggcaccagcctcatcgtccggccctccggcaccgagcccaaggtcaaggtctatatcctggccaacgacgcctctaaggaggcctgcgacgccaaggtggacaagtatgccgcctgggccgagagcctgaaaaagtgagtgaatagagtaaaccggttccccggcgtccgcgccggggaaccggttttttcacgtcgggagcagcacggatttccagcctcccggagtagcgggaacctgaacagaggcggtgtcgccccaaaattcattttacaccctgtgcacgggcggcacttgcggccgccccctttttgcccccgctgggaacgcttcgccccttaggggcggggcttgtccccgcccgtgggcggccacaagggccgcccctacttccggggttccgttcccggcggactaccttgtggcgcttgtgtgtaggggcgggtgcccacacccgcccggagctggccggtggcccggaggggcggggcttgtccccgcctgcgggcggccataaaagccgcccctacttccggggttccgttcccggcgggctatcttgcggcgcttggacgtaggggcgggtacccacacccgcccgcagggcgtccggcagaaggagtcccccgcgtccggcggtacgccgggcgcgggggactctcatatcccgaaagggggaatatttatggaaaattatacggaacattatcagctccaccagtgggaatcggaggacagcttcctgcggacggatttcaacgcggacttcgccaaaattgacggagccattgccgcgtgcagccacacggtcaaaggctcctataccggaaacggaagctatttgacagtggagctgggcttccggcccgcggcggtgctggtctcgctgggatatcagtcctacaaccagccgcggctctccatcgacggggacaccgcttatatggtcatgactgacagcgggttccgcgttcaggatgaccgcaacgcaaatatgaacgcagagggtagggcctatctctatctggcgttccattaaaaaatttccccggccgatcggccggggaaattttttgcggagatagtgcttacttcacgaaggtgaaggcgtaataggtgacatccccattgttgttcgtggcaaacaccacataggtaccaggggcaacattcttaatctcgttgctggttgtattctggattacaatggcaccagaggaagtaggttggttagtattccccaggttagcgttcagtgcagcatccttttcaccgtagacaacagcagtaccgtagcagggaactccgccaccggtagcattctcggtgtacacattcagggtgtagttctgagccgcgtcggtaaacatctgaatttccttggcattttcaaccgcagctccgatcgtcttgtagccagtgggctcgccaatacccttgccgttgacagtgacgctcttgatcatgtcgcccttagagtcgtcatcgccagcgtcaacgtcaacctccatcttgtaggtatcggtgacatacacgacctcggcctggccgtcatcgttgtacaccacgataccgtactgaccggaggtcaactcagtggtagcggcagtcttgtcgtccacctcggtgttctccacgtcgataaccagggccttgtcggcatagcgctcccagtcggtgttggagttgtcattgacgccactcacgaaggactgcttcacagtctcgtcatcggacatcagatcagttgccttgtcgaagtcatagaccttgaagtacttggtgcgggtggtaacaatcaggcccacgtcgttggccacgtcagccgcagcggtcttgttgctgttagacacacaatcggcctgagcctccagtacgtagtagtcgccatcggtcgtgtaggtgcaaagcttgccggccattcccttggtcttggattgcatctggagaacgttgccctcttcgtcaatgacggagtaggtatacacgctaccggacttgtcgtagacgctcatgacatagacataggcgtcggtgccgaacttggcctggtcagtgtagagcacgatgacctcggccacgtcggtggcatcgtcgaaggccaccacggaggcgcggaccttgccgttatcgataccacccgctttatcagcgtcgatcatcttggccatgttgtcatagcccacggccacatagcccttggatccattatagtagtaaataatggtttcctcgtcgataccatagctgttggtgtgggtatcaacagagctgttctccagacgcaggtcgacatcgcctctggcaacatcagccttcagctcggtctggctactatggaagaaagtagacttcccgctttctgtgtagttgtcgcctttgatatagtttttgctggtgccattgacgatcacgccgtcatccagctcagcaggcccgaaggtcacgacctcatcgtcgtcaatggtgtaggccaccaagttgccggaggcatagcccttagtcttggcaccggcagcggtagcgtcatcggaacccatgaacttcaggacggcgtccatggagttgtcgtcggtgatcgcactgccaaaccaggtctcaaccgcgctgtccttggtgctgttgtcgtcggaattggcgagatcctcaaagcggtcagcggtggcgtccatgtccacgtcatagaccttggaggtgccgtccgccagcagcagcttgatctggccggtggtggtcaggccgttgatggagtaagcggagtccagagccagagcgtactgggtgggagcgccctcgacctcacggaaggccacgatgttgccgaagtcgtccaggaagaagtcgtactgagcgtcaaactgcacgccgttggccttatcgtcacactcagagatcaggaacttgacggggttatccttgttgatgttgctcagaacctccaggccgtcctgcttgtactcctcgccgccgaccttgatgtagttcttgttgtcgtccttgttcttggcgttgaagagctccatctcaccggtaacggtcttgggctcctccacataggtacggccgccgtactggacaaccagcaccacgtcgcccttggtcagatccgtggcagtggtcacgatatcctcgttgtcgatgacatcgtcgccgggcaggccgtacagagtggtggtctcgttcttggagctgacgccggacacgtgggtcagggacttctccacggagatgacatagttgacatagccgtcgttgtcgttgtcgatgacggtcagggcggcgcccttcacgttcatgatatcgtccacatcagcgctgtcaatggccacttcctcatagttgtggtaatactcggtggccttatcggtggccaggccagtgcccttcagcagggcggccagggagtcgtcgtccttggagtcgccgccggtgaccttctcgccggtctcaatgacggtgttcacgtcggagaccacaggagcgccatacacggtggagtcggccagaatggtggtcttcttcacgtacatggtgacggccttacccagcatatcaacaggagtgctgacattgaagacctgggtcttcacgttggcgctggaatcctgggccacggcggtgttgccggtggtggacaggatgccgtcggggttgtagatgcgggtcttgccctcctgcagcgcggtatcggtgtcgtcgtccaggatggcccactcattggcggtgacaacgccctccaccttgatcacgccgtacttgtcggacaggatggtgcggtgatcgctgtaaacgatggggtagttgttggtagtgtagctctggatcatctccacgtccagggcgttgtagatcagcagggccgcgtcgtcgcggttcaggggagcggacagatccttggtgaacccttcgaagatgccctgctcgtcggcgcggacggacacgttgatggcccagtcggcaccctcaaagccctcgatcttgggatcgtagcccacggccaccagcagcatcttggccgcctccagggcggtcacggtggcgctgggatcaaaggtgccgttgccgcggccggcgatgatgccggtggtgtagcagtagttgatgtggcccttggcccagtggctggtgatatcggtcaggccggagttgacgctctggtacagagcgctgttgtccacgcccttgttcatgatgacggagagcatcttcgccatctgagcgcggtcaacattttcggtgggtgcataggagccgtcgggcttgccctcgatgatgccgagggaaaccagcatggaaacggcgtccttgttcacgatctgatccttatcggtgagatcgttgtagctcacagcggaggcggagacaaccatcatgccgatgagcatgatcgccgccagagccaggctgagagcccgcttgaggtttctcatttgaatttcctccttctgaattttgaagcctaggggcgtatgacgccccttgcaagccatgaaaaaggagggattccccccacatgcagttccaaatggcacaaaagagcggcaaaaagtggcgttggtagacatctggtagacacgccgggcatgccaagcacaaaaagagcccggaaccgcaacggttccgggccacttttggtagacatttggtagacttaaccttaaagcacagtacaggtcacttgagccaatcacacacctcagccaggctgatgccctggccgcgggcgatacgggccacatcctcgtactccggcttggagcggacgacgccccagccggaggcggtcttgagccgcacggggccgtggggggtatccacggtgcgctcaccccgctccagggtataccggcggcacacattctcccgcacgcccagagtggtggtgtgccggaaaagcaggccaagcagcctctcccgatcctccatacggcacatacaggagagcagcacggcggggcggcccttcttcatgccgatgggcgtggtatacacgtccagtgctccggcggcaagcagctcctcctgggcaaagccgagggcctcggcggtcatgtcgtccagattgcagcacagctcggccacctcgtccccgccgcccgcggtctctcccagcagggcgcggacgcagttggccgcctcaaagtccttgttccccatgccgtagccgatttttttcaccttcatcaccggcatggcgccgaattcggtgacaaagtgcttgagcagcgccgcgccggtgggggtgcacaactcaccacggatggctccgccgtagatgggcacgtcccggagaatgtgggccgtggcgggggcgggcacgggcaggatgccatgggcgcagcgcacctggccgcttccaacgtgtaccggggaggccacgatacgctccacacccagcatgtgcaccagcaggcagacccccgccacgtcggccaccgcgtccaggctgcccacctcgtggaagtggatctcctccaccggcgcgccgtgggcgtggctctcagcctccgcaatcaggccgtagaccgcctccgcatcggcccgtaccgcctcgggcagctccagatggcccagcagatggcggatctcccccattccggtgtggtggtgatgtccatggtcgtggtcgtgatggtggtgctcgtgttcatggccatgttcgtgctcgtggctgtgctcgtgaccatgctcatggctgcggtcgtgatggtggatgtgcccctccggggatacgtcgcagctgacctcctcctccccgtgtaccgtcaccgccacatgggtgccggtgatgccgcatttgacggccggtacggcggacaccgccacgccgggcaggcccaggccgttcatcttctccagaaaggctgccttgtcgtccacaagctccagcagggccgccatgagcatatcgccggcggcccccataccgcagtccagatagagtgttctcatttctgtttccctcccatgtggttgatcatgctggccagatagcccgcgccgaagccgttgtcgatgttgaccacgctcaccccgctggcgcaggagttgagcatggacaacagggaggacagaccgtggaagcaggccccgtagccgatgctggtggggacggcgattaccgggcagtcggccagcccgccgatgacgctggccagagcgccctccatccccgcgatggcgatgatgacgttggcgctcatgagctcctccaggtgggagagcagacggtgcagccccgccactcccacgtcgtacaggcgcaccacctcgttgcccagggcctcggcggtgagggcggcctcctcggccaccggcatgtcactggtaccgccggtggccaccaccaccttcccgctgccgtcgggggagggaaggctgcccacgatgccgatgcggcccatctcgtaataggtgaaggggtgggccgggtcaatggccgccgccgcctcgtccgacatccgggtgatgaggatggtgtcctgcccgccggagcgcatggcgtccacgatgcgggcgatctgctccggggtcttgcccgcgccgtagatcacctcggccaccccctggcggaggccacggtggctgtccagcttggcaaagcccagctcctcgaacggctccattttcagcttgagcagggcgtcgtttacatccacctgtccggcggccacctgctccagcagggctttgatcgctctctgttccattcagcgctcctccaaatccagcagaatcggcttgaaatagggggccagggccgcccgcaggacggcccgctcccggacggcccgctccagctgtccggccggaagctggagccgtgccgccccgtggaacacccgcacccggaagtcagtgtaccccaggcggaacagggcgtcctccgccccctccacccgggccaggatctccccggtaatggcttccccggtgggaatccgggtggccaggcaggcataggccggcttatcccaggtaaagaggcccgcctccctggacaggcggcgtatgtccgccttggtcaggccgcactcccgcaggggggagcgcacctccagctcccgcagagccctcatgcccggccggtcgccggcctcgtcggaggcgttggtgccgtccagcaggacggtatacccgtcggccgcggcccgcgccttcagcgcgcggaacaggttctgcttgcagtagtagcaccgctccgccgggttggccgccacccgcgggtcggccagggcgtccagctccagcaccgtcacctccacccccagttccccggccagccggagggcgtcgtcccgctcaaaccggggctggaaagcggtcttgatgtagtaggggcggatatccgccccggcctgcaccccggcgtacagcagataggccgagtccaccccgccggagaagcccagggcgcacttgggatgggctgcgaaaaactcgttcagcgtcatgtttgactccttacaggtcgaagcggttgtaggcccggaagcagtccaggcacagctttttcccgttctccagccggagcaggtgctccgccgtcacctcgccgcagccgtcgcaggggagggactggaagagccgggccttctcgggcagggacagcacggcgggcttcacgtcgaaaagggacgcgggggcggcgtcctggaggtagcggaaccgctcctccttagtctggtactccgccggagtggggcggagcaccaggcgcaccgccttgccggtcttccggttgtagaaggagaaggcctgcttgccccggaggtggaagagcaggttgcccttgcccacgctgcaccccagtagcacctgaatggcgtccacgccgcaggcgtcgttctccgtgatgcacaccacgtcctcgtcggcggagaagtccagctccagcagctccatggcgtaccgggcggcctggaagccgatggtcaggccgccgcacgcatggccgtggaaggccacgcatttgtcccagagggcttgtcggtccatattcattcgtcctttctacggcgtagggctagcccgcgtcaaacaggccgtcaaaacgcacttgaatgtagtcgttggggttcagccgggtgagcgcccccttctccagacggaagagacggtcggaaatcttcagggcgctgtccagatcgtgggtgatgaacagcatggagaagccccggttgttctgcaggcccttgagcatccgcagcaggttggccttgcccgaggggtccagcatggaggtgggctcgtcggcaatgagaagggccggctccatggtcagggcgcgggcaatggccacccgctgccgctggccgccggacagggcgtggatgtgccgggtgagaaagctgtcgcaggcgaaaaggcccacgtcctccagcgcccgctccgccgccccgtcctgaaagcagccggacagtcgcatgggctcctccaccgcctcccgcaccgtcatgcgggggttgagggcggcctggctgtcctggagcaccatctgcaccccgcccagacggcggtggagggcggcaaagtcggccgcctccccctggaactccaccgagccgccgccctccagggggagcagccccgctagggtgcgggccagggtggtcttgcccgcgccggagcggcccaccagggagacgatctccccgctgtagagggtgaggtcgatgccgtccagcacccgctgccgcccgaaggctttgcaaaggccccggcattccagcagcgtgagcacgcccccccggttgcaggccaggaggcggccgtctggctgcgccgtcagctccggggcgtggccggcgcaggcgggcaggctctgggtacagcggccgtaaaaggggcagccgtggggctgccgggtgtaggagacggtggtggggcggatgccccacatgtcccgcaccgggttgaggcccaccgccgactggagcaggccccgggtgtaggggtggcgggggtggtccaaaagggcgcgggtgtcccccgcctcctccacgtgcccgtcgtagagcaccaccgtccgcccgcccaggtcggcggccagcttcatgtcgtgggtgatgaccaggaaggcggtgcccagcctgcggtttaattcctggatcagcgccgtgatcccccggctggaggcgatatccagggcgccggtgggctcgtccagcagcaccagggcggggttgagggccagggcgttggccagcaggaacttctgcaccatgccgccggacagctcccggggatagcgctccagatccgccgtctccagacccaccagggccatcagctcctccatccgcgccgccatggccgccccccggtacgcccggcacagcacctcccgcaggtgctccgccagggtgagggaggggttgagccactcggccgagttctggaaggagagggcgaactccttcatgcgcaggggcctgcgcgcccgctcgtccatggccagcagctccctgccgttgaggtacacctgcccgctgacctgggcctccggctcggacaggcaggcgatggcgcgggccagggtggtcttgccgctgcccgactcccccacgatggtgagcatttccccggcgtccagagcaaagctcaccgggtgaagggtgaactccgggtaggacaccgacaggttgttcacttccagcagcacggcttgtccctcctctgttgttcctccagcccgcccaccagcaggcgcagcagcagcgtggacagcaccagcgcccccaccggcgggaggagccaccacgtccagaagtccgtccggtagagaccggggaagtccacggcccgggcgatcatcataccccaggagcgggccagcgggtcggacaggcccagaaaggccagggaggactcctggagaatggcccgtcccaccaccgccagggcattgatggtgagcagaggccacagctcatggccgatgtgggtgcggatgaggtaccaggttccgccgccgtagagccgggccatctgcacgtagtcccgccgccggatggagatggtcttggcccgcatctgccgggccaccggggcccaggagaaggcggcgatgatccagaccaggttccaggtgctctgccccagaaaggccccaatgacgatcatgaccgggagctgggggatagccagaagcacctggatcaggaaggagatcagagcgtccgcccagccccccacaaagcccgccagtatccccaggccgccccccaccgcaaaggtgaaggcggcggcggccaggccgatgcccaggctgcggaagaagccggcggagatctgggcgtagatgtccacccccaggttgtcggtgcccagccagtgggcggcggagggggcctccagggagccccccgacgggagctgggccgggtgggggtatccggtgaccccccacaggaagcagagggccagcaacgccagcaggagcaggggaaccagccatttgcgcctcatggcccctcctcctctccgtccagccggcggttgaccacgtccgccgccgccaggctgaggagcaccagcacggcggacaggaggaacaccccctggagcatgggatagtcccggtactgcaccgcctcccgcaggacggtgcccaggccggggtaggcgaagacgttctccaccagaatggtgccccccaccgcgccccccacgctgaggaaaaagcgggccacgatgggggtggcggcgttgcgcaggatataggcggtgcggatgcgccccgcggtcaggcccttggcccgggcgttggtgaggtagggcctgcccaggatggtgaaaaagctggcccgggcggtaaaaaagagcttggggaccgtgaccagggtgagggcgcacaccggcatcaggctgtgcaccaggatgtcccccagccgctgccacaggccgtcgtactgggcgaagggggtgtaggccccggagaggggaatccacgccgcccgggccgccaccaggaagagcaggagcacaccggtgaggaaggggggcacctccgccagggcggagaggaccgggtagagcgcccggtcgacccagggccggcggacgcacagcagggacagggccacccccaggagcaggctgagggccagggtgctccccatgatccacaggctccagggcaggcgctccagcagaatatccgccacgggccgcttatagtggatactctggccgaagtccccgtggaggttgtccacaatggtatccctcaactgtggaaaaaagggcttgtccaggccgtagtaggcccgcagcagctccttctgctcctccgagtaggcggcgtccacatcgtccccggcggccccggaggtgtagtcaaaggggtcgcccggcatcagccggggaatggagaagttgaggagatagatgaccagaaaggcccccagcagcatcagcagcttttttcccatgcttctcctttcccggcggggcggacctcagcgcgccatgtaggacaggcggttctgctccgcctgctggtaggcgtaggtcttcatccagccgtcatagacatccttgcggtacatggagtaggaggactggttggcgatgacgatgatggggatctcccagctcaccagcagctccagctcctgaaacagctccacccgtttgtcaaagtcggtctcgtacatctggccctcggccagcgcggtcatctcggcgttggaatagccgatggcccccatggagtgggggttggtgccggagaacttggactcgtcggagaacagggtgcgcatgtaggtggggggattgttaccccagccgccgttgcccaccagggcgaactcgtagtcgccgctgttgatgcgcccgtcccgggtggccgagtcgtgggcctccaccgtcacctcgatgcccgcggcggtgaggccgttgcggatgatctccgcgatggccaggtcgtccccgtcgtcgccgcacagaagggtgacggaatagcccttccccgcaaagacggcgtgggccgcctccgggtcataggggtactgcaccacgttctcgttatagtacaggctgccctgggggacgtagcccgcgctgcccaccgtgcccgcgccgcggaacacgctgtccaccacgctctgccggtcgatggcggcgtacaccccctgccgcagggcgagctccaaaaagtcggggcaccgctcgtagttgatgagcagcttatagcccatgtcgttggccttctccaccacgccgatggacgggtcgttcaaataggtgtccatcaggtcggcgggcagggaggtgatgtcgatctccccgctctcaaaggccagcagggggtcgctcaccggcacaaactggatcttctccgccgcctgctccccgttgcaccagccgtcgaaggcagtgaactcatagctgccggtggccccgtcataggcggtgcaggcataggccccgctgcctgtcagatagccctccccggtgtaggagttgggatcgtccacgctctcccagatgtgcttgggcaggatcacgaaggagcccaggttggacagggtgtcggcgttggcctccttcacggtgatggtgatggtctgctcatccaccaccgtatagtggtccaccagatagccgtcccccacccccagggagttggacaccggggggtgctcctgatagtagtccagggtgaaggccacgtcggcggtggtgaggggcgcgccgtcctggaattgggcgtctgcaaagagggtgaaggtgtagtcgttgccgtccatggaccagcgctccgccagccagggcacgtcgccggtctcgtccttctccagcagactgccgtacaccaggcgcatcttggccgtgccggggccgcgggactggtgcagatagggatttgggacgccccagtcggtgcccccctccaggcggagggtctccacccggcggccggaggcggagccgctctccgacggggccgtcggggtgacggcggcctccggcgcgccgccgcagccggccagcaggccggcgcacagggcgcccgtcaaaagcaggccgaccgctctttttccatacttgctcatgggtctctctccttttcttccccggacacaaaaaaagcccaccatgtgcgcgcaggcgcacatggtgaacttcggttcaccggtttcaacggccgggggatgggtgtggaaaaaggcttcagcctttctaaagccgcttcagcggctcgtttggctcagtatagcagaaaaagggcggggctgtcaatcctgttcccccgatttcgccgcttttcccgccgccccggctgtgctatacttttaaccaaagggggttatggaaatgtacgacctaactgcaatgggggagctgttgatcgacttcacccagctcagcaccgatggagagggctatcccaccctggccgcccaccccggcggggcgccgggcaattttctggccgccctctgccgctatggggcctccgccgcctttctgggcaaggtgggggacgacgccttcggccgcctgctggtggacaccctggcccgggcgggcattgaaacccggggcatccgggtggacccaactgtgttcaccaccctggccttcgtcaccctcgtggacggagagcgctccttcagcttcgcccgcaagccgggcgcggacaccttgctccgctttgacgagctggagctctccctcatcgaccagtccagggccttccacttcggcgccctcagcctgaccgacgagccagcccgctccgccacccggcaggcggtggcctacgccaggacgcagggaaagctcgtcacctttgacccaaactaccgtccgcccctgtggcggagcgaggcccaggccagagcggaaacactctggggcctggagcaggccgacgtggtcaaactcagtgacgaggagttgtccttcctctggggctgtacgccggaggagggggcccgccgcctgcgggaggagtgtggtgtggctctggctatgatcacactggggccccaaggctgttacctggaaaacgccaggggggcctgccgggtgcccgccccggcggtgcggccggtggacaccaccggcgcgggggacatcttcgggggcagcgccgtggcgaagctgctggccctggacacacctccggcggagctggagcccggcgcgctggagggcatcgcccgcttcgccgtcaccgccgccagcctgtccaccctccgccccggcggcatctcctccatccccacagaggcggaggtactggccgctctggaagagtaatagaaggcccgccggagtaccggcgggccttctattattcttcaggctgtcgaaaaaccttccccaaaggagggcctcggaaatgacacttcgcatggcggaagaggtgacaattttgcgggaaatcgttccccttccgccatacaatctttttcggcaggctgtattactctctgcgggtcttgaggcgggccatggcccgggccagagccgccttggagtggtaatactcgtggatgctctgcttctgacgcagacgttcctcggcccgctcccgggcggcctcggcccgcttgcggtcgatctcctccgggtgctcggcaaagcccaccagcaggatcacatagtccggcttgatctctacgaagcccgcgcctacggcggcgggctcccatttgccgtccaccttgtagtgcagctctcccggctccacggcagtgaccgccggctcgtggccggggtacactcccatctcgccgtccacggcgggaaagaccagggcctcggcggggccgatgtagaactgccgctccggggtgatgatctccaggtagaaggtggaagcctccgccatttacaccgcccccattttcttggccttggcgatgacctcgtccacgttgcccacgttgctgaaggcggcctcgggatacttgtccagctcgccgcccaggatggtttcgaaggagcgcagtgtgtcctccagcttcacgtagcggccctccaggccggtgaactgctcggccaccgagaagggctgggagaagaactgctggatgcggcgggcccgctccacggtgcgcttgtcctcctcccccagctcctccatgcccaggatggcgatgatgtcctgaagctcccgatagcgctggagcagctcctgggtgccgcgggcgatcttatagtgccgctctcccaccacgtcgggctccagaatacgggaggtggactccaggggatccacggcgggatagataccctgctccacgattttgcgggagaggaccgtggtggcatccaggtgggcgaaggtggtggcgggagcggggtcggtcaggtcgtcggcggggacgtagacggcctggacagaggtaatggccccgtccttggtggaggtaatccgctcctgaagggcgcccacctcgttggccagggtgggctgatagcccacggcggagggcatccggcccatcagggcggagacctcgctgcccgcctggacgtagcggaagatgttgtcgatgaagagcagtacgttctgcttctcccggtcgcggaagtactcggccatggtcaggcccgtcagggccacccgcatacgggctccgggcggctcgttcatctggccgaagaccagggccgtcttttctatgacccccgactcggtcatctcccgccagaggtcgttgccctcgcgggtgcgctcccccacaccggtgaagatggagtagccgccgtgctcggtggcgatgttgtgaatcagctcctggatgagcaccgtcttgcccacaccggcgccgccgaacaggccgatctttccgcctttggcgtagggggccagcaggtcgatgaccttgataccggtctcgaagatgtccaccacggggcgctggttctcgaacgcgggaggttggcggtggatggaccacctctcgctggcctgcaccgggcccttcccgtcgatggcgtcgcccagaacgttgaacatgcggcccagcacgccctcgcccacggggacggagatgggcgcgccggtggcggtgacggccatgccgcggcccaggccctcactgggggagagcatgatgcagcgcaccgtgtcgccgcccacatgctgggccacctccatgacctcccggcggccgtccagctccacctccagggcctccttcagctccggcagagcgccgccgtcaaaggccacgtccaccacggggcccatgacctgtacaatggttccttgcttctcactcataatggcaaaatcccctttcgggcgttggtatgttctgtctatcccctctccgtgggatgttacagggccgcctgggccccgcctacaacctccgtgatttcctgggtgatagccgcctgacgggcccggttgaaggacaggttcagacgctggagcatagcccgggcgttgtcgctggacgacttcatggccgtcatgcgggcattctgctcggagcaataggactccaccagtgcgccgaacaggtctccctttacatagccgggcaccagccggtccatgaccgccttcaccgagggcacatacaccacgtcccggttatagctgtcccggttcttctcatattcaggaaacacatcggggtccaggggcagcagcttgtgggcggtgggctccatctggaaggagctcaccattttggtaaagaggacatacacctcgtccaactggccgtccagatagaggtccagcatcagctctgccatatcccgggcccggcccatgttggggtcctgggccgtgtagagaaactccacgtcgatggggatgccgtgctccaggaagtaggagcggcccacctgccccaccacaaagaggctgggattggcggccctggacattttctcctcagccagcttgagaatgttgtggttgtaggcccccgccagccctttgtcgccggtgatgacgatgaagcccgtcttccgtttgtcgggcgggataccggggcgcttatcgaaaaagcggtggtcgatctccggggagtggtggaggatatcggagatggtggcctcgatcttgctgaaatagggctccacatcggtgagctgcctgcgtgccttgcgcaggttggatgaagagatgagatacatggcgttggtgatcttcagcgtctgctccacgctcttgatgtgggtacggatctcctttatgcttgccatgtggcgctcccccgcttcttggcgtcggccagcgccgcccggatgcactccactgccgggccgctcagggtgccggtagactcaatctccgccaccacatcggggtgctcggcctctatctcgccggcaaagccaagcacgaaggggcgcacgtgctccagaggcacgtcgtccaccaggccgctggtggccacatacaggaggatggcctggcggcttaccggcatggggtggtagaggggctgcttgagcagctccagcagccggcggccgtggtccagggcctgctgggtagctgggtccagatcggaggcgaactgggtgaagacctccagctcccggaaccgggccaggtcgatgcgcagggtgcctgcggtcttcttgatggcccgggtctgggctgcgccgcccacgcgggacacggacaggcccacgttgacggcgggccgctgtccggcgaagaacaggtcggtttccaggtagatctggccgtcggtgatggagataacattggtggggatgtaggccgacacgtctccggcctgggtctcgatgatgggcagggcggtcatggagccgccgccgtactccttcgtcaggcggcaggcccgctccagcaggcgggagtggaggtagaacacgtcgccggggtaggcctcccgtccgggggagcgcttgagcagcagggacagggtgcggtaggccaccgcgtgcttgctcaaatcgtcatagacgatgagcacgtccttccccttgcccatgaaatactcgcccatggccgctccggagtagggggcgatgtactggaggggggcggattcgctggcagtggaggacacgatgatggagtagtccatggccccgtgcttcttcagggtgtcctgaatgcgggccacggtggatgccttctggccgatggctacgtagatgcagatgacgtcctgtcccttctggttcaggatggtgtccaccgcgatggcggtcttgccggtctggcggtccccaatgatcagctcgcgctgtccccggccgatgggcaccatggcgtcgatggccaggatgccggtctggaggggtacgttgaccggctcgcggctgaccacgccgctggcctcgtgctcaatggggcgggtctcggtggtctcgatggggccgaggccgtcaatgggctggcccagcacgtccaccacccggccgatcaggccgtcgcccacggggacgtcggcggcccgcccggtgcggcgcaccacggtgccctcccggacgccggcctcgctgcccagcagcaccacgcccacgctgtcccgggccaggttcatgaccatgcccttcaccccggtgtccagctccaccagctcgccgtacaccgcctgatccaggccgtagacggtggcaatgccgtcgcccacctccaggacggtgccgatctcatcccggcgaacccgggtgtcataattctgaatctcctcccgcaggacggagacaatctcttccggttttgctctcatgccattcgcctctcttccagttggcggcccatccggcccagcgccccgcggacgctcttgtcatagcgcacgccctcgatatccagggtaaagccgcccagcagggccgggtcggtgcgcacgtcaaagacgatctccttcttgtggtggagacggcacagggccgcccggagcttctccagctcctccgcctccagcgggtgcacacaggtcagcacgcaccgggcgccgccccgccgggccagctccagcccgtgaaacgcctccacaatctcaggcagcagggccatgcggcccttctccgccaggaggcggtaaaaatgcggcagtgggccgccctcctccagcccgggcagccgggccagtacccgccccttttctccggcctggacggcgggggagcagagcgcctcccaaagggcgggctcctccatcagggcccgggccgtgcgctccagggcctccccgtcgggagagacctgccacagggcctgggcatagcggcgggcgagctcgctcatgcctgctcacccacttccgccaggaaggagtccaccagcgcccggtcgccgtcctccgtgggccgctgggccaccttggcggcggccagcagggccagggaggccacctcgttccgcgccccgcgcagcatggcgtcccgctcggaggcgatctgcgcctccgcctcgctccgcagccgcttggcgtcggtctcggcgtccgccattttggcctcataggcccgctgggcgcggttctgggcgtcggccaccagcttggccgcctcctgccgggcgtcggtgagcttgtcctcatactccgcgcgcagctcctccgcctggctcttgctggcctcggcggagtcgatggtctccttcacccgggccgcccgctgctccagcacggcgttgacccggccgaacaggagcttgcgcaggataaaatagagcaccagcagattgatgacggtaaagacgatggtggaaacttggaagtccagcattggggacgcccccttaacccatgaagatcacgagcagcgcggtgatgaagccgaagatggcggtgccttcggccagggcgcagcccagcagcagggcgctgttgatctttccggcggcctccggctggcgggcgatggcctcgctggccttaccggtggcaaagccaatgccgatacccgcgccgatgccggtgaaaaccgcaatacccgcagcaataattcccagtgtcataatgatttcctcctaaaagcgattgatttagtcttcctccttgatgccctcaccggtaaacagggtggtgaggaacacaaagacgacggtctgaatgagcccgtcaaacaggtcgaagtagaggctgaacaccgccggcagcaccaccggcaccagcagcttgagcatctccatgatgatgaaggcacccagaatgttgccgaacaggcgcatacacagcgccaggggccggatggccacctccatcaggttgatggggatgagcagcggcatgggctcggcgaacttcttcaggccgcccgccaggccgttgtagcggaactgggcgccgtagatgagaaacatactcatgagggccagggctgccgtcacgctgatgtccttcgtggggggtgtcaggccaaagaccccgatgaggttgctcaggccgatgtagagggccaccgtccccagccagggggcgaagggccgccagtgggcgcctatgttggtcttgacgaagccgttgaggaactccaccgtccactccagcgcgcactgtaccttgccggggcggtccacgctgagccgacgggtcagcgccagggccagcgcgatcagggccgccatcacaatccaggtcactaccaccgactccgccactgggacgccgcccagcaccgggacggtaaaggccaccttgtttcccagctcctccaccagggattccttgaatgcatccaaactcacaactcgcatcacctcgttttcgcgtgggctatcatactaccagccgggcagctttgggaacccttttgaaagtaaaaaaactttcgaatatgtccgtgctgcgctttcgtttgacagcgtggctgaatttatcttatactgatcccaaccgggaaaaaggaggcgcattgtccatgtccaaccagaccgggcgttccatccgcgcccagctcatgtggctgagcctgattatcgtcaccgtctcggtggccctttccctggccggcaccctctacatcaccctgcggaccgagcggaagaccctggaccagaatttgcttaactccgcatccattctctcccaggtgcccctcgtgagagaggccctgctgggggaggtgcccgcagacgagctggccgactttctggatgcggccaccgcccgcacctcggatatcgatctgattctggtgggagacacggaaagcgtgctccgctatgcgccagaccgcagctttatcggcagccgctacactggctccgcccagaccagcgccctggcaggggcggagccctatacctttgacgacagcggtccaatgggctccgaccactcggcctacgcccccatccgggacgaatccggggcggtaatcggctttatggccgtggggctctacctgcgcagcctgacccatgtggcgctgaccaccgccctgcgcctggcggccatcggtgcgctggcggcggcagtgggggccctgctggccctgcggctgtcccggcgcatcaagcgctccctgatgggctacgaaccagacgccttcgcccggcgcttccaccagcgggaggacattctggaggccctggaggaggggattctggccatcgaccgggaagggcgtatcatctttctcaacgccgccgcagcccagatgctctccctggcgccggaggccgccatgggccgccccctccactccgtctacccctcttccaccctggaccgcattctgcgcaccgggcggccggagtacaacgtgagcatgaagtccctcaaggacgtgcgggtgctggctgaccgcctgcccctgtatgaaaacggcgctctggcaggggcggtgggcatcttccgcaaccggactgaggtggcccggctggccgacgacctcaccggcgtgcggcacatggtggatgccatgcgggcctatacccacgaattcatgaacaagctccacgttatcctgggcctgctgcagatcggcgagccggagcgggcccagcagtacatcatggataccacccgtacccagcaggaggcggtgagccgcatcatgaaccagattaaggagccctcggtggccgccctgctggtgggcaagaccagcagggccaacgagctgggtatccggctcacgctggatcgggagagcgtcctgagtgccggaacctcttggctctcccccgacgcctgggtgaccgtactgggcaatctgattgaaaacgccattgagggcctgaatcagacccgccgtgggaccaaggaagtctccgtcagcatccgcgagggggcggataacctgtttctctgcgtggaggacaccggccccggcatcccctccgccctgcggcgcaccctcttcgagcgcggagcctcctccaagggccacagccgggggactgggctggcgctggtacgggaggtagtggaggcttaccacggcgacatccgggtggagtcggaaaccggcgtaggcacctcattttttctcagcttccgccgggaacccctcccggcccccaaggaggaaccctgaatgtaccgcgttgtcattgtggaggacgaccccatggtttccctcctgaaccgcacctttgtggagcgggacgcccgcttccaggtggtgcagtcctttcaggacggccgggccgccctggcctggctggagcagaaccccgccgatctggcggtgctggatgtctatatgcccctcttcaccgggctggagctgctccacgccctccggggccagggggttggtatcgacgccatcatggtcaccgccgccaacgacgcccccaccgtggacaccctgctcaagctgggggtggtggactatctggtgaagcctttcacctatgagcggtttcagcaggcgctggataccttctgccgccaccgggatgcggtggccggggacgcggtggagcagagcgcgctggaccggctcttttcccccgccctcccggcggagcaccagccgcccaagggcctccaggagagcaccctggagcttgtgcgcgcctgcctgcgggcggcaccgccccagggcctgcccagcgaagccctctcccgccagaccggcctttcagtggtgacggtgcggcggtatgtcaattacctggtagagcggggggaggcggccagcgccgtcaactatgacacaggcggccgcccctgccgcctgtaccgctgccccggcccgcctgcctgaaccccttccccgccaatggcgcgcgcatctgtaaggaatgcgcgcgccattggccttttccggctccgctcctcctccccggaacagaagggcaaagtccaaataccagagccgggcagccgctgagccctaactgcaagggcccgcaattccagcggaattgcgggccctgttttgcctcagaaggatggatcgcggaagacgcacgccccgcccacataggtgcgcagcacccgggcggagagcagttcctccggcgggcaggtcagcaggttgcggtccaccaggaggaagtcggccagcaggccggagcgtatgcgccctttgatgcgctcctcaccggaggcgtaagcgccgcctgcggtataagcgtacagcgcctggtagggcgtaagggcctgctccggcaggaaggggccgtttccggtgaagtcccgccgggtgacggcgcagtagaccccctccagggggtgaaagcactccaccgggcagtcggtgccgaaagccatgtggaggcccagccgctccatgtcgccccaggcgtaggagtgggccaggcgttttccgcccagtcgtccgggggcgatgtgcatgtcgccgttgatgaacaccggctggacaaaggcggtcacatccagctccgccatgcggcggagctgcccctccgacaggatctgacagtgcaccatgccgtgacgggggtgcagccagggcagctccgcgcgggcccgctggaaagcgttgagcaccatctcagccgctccgtctccgatggcgtggatggcaacggccatattgtgccggtgggcggtgaccaccagccggtccaactgtgcctgctccgggtagatgggcaggccgcaggtgtccggggcgtcggaatagggctcccgcaggaaggccgtccgcgcccccagggagccgtcggccaggagcttcaccgtggagatgcggaagcggtcgccgccgccgaagcaggccccgccccgggtgaagaactcctccagggtctccggctcggtgagcagggcctgctcggaaaagcgcagcttcagcgccccccgctcggccagctcccgcaggccgtccatgagggcatagggctcctcgtccggcgcatacttgaaatcgtcgctctgtatgctggtcaggccctccgccagcaggtcgtgctgggactgaactacctgctccagcaggggcctcaggcccacggaggggatggcggccttgatgtcgtccaatacgttctccttcaccacgccgttgggcgctccggtctcgtccacctcggcaaaggcgccgtagtgccccaccgtgtcccggttgatgtgcagcagctccagagccctggaattgagcgcccccacgtggaagcaggagcgcaggatcaggatggggtactccgtactcacctgatccagctcccggcgggtgggaaagcgccgctcgccggtgaactgctcctggttccacccctcgcccagaagccagcggccggagccggcctccagcccggccagcccccggcgcaggcgctcctgcacctccgccagagaggtacagccgaagaggttgacggacagctttgttttgacatagtggatgaagtgcaggtgggagtcattgaagccgggcattacaaagcggccctggaggtccagagtctcccaggctcccctggaaaagcggcgggcgaagtcctcggcgtccgcccggccgcccacataggcgaagtatgcgccgtccaccacggcggcctccgccattgggcgggccgggtccatggtggcgatggttccattggtcagcagcagcatggtgtttctcctctccgcatttagtcccggaacgggtcgggatcaaagtgctcatccagggctgccagaaactcggccagcacctccaccgtctgctccacatcggccagagagcccacctcactgggggagtgcatgtagcgcaggggaataaaaagggtggtcacgggcaggcccacacccgtctggttgagcttatccgcatcggtgcccataacgcctggggtgacggcatactgcagggggattcccaaccgcccggcggcctcctccagcgcccggttgagaggcgcgctgcacaccgagcccttggccagggcggggccgccgcccagcttgatacggccgaagcgctgggggggcataccggagaaatcagaggtgtggatcacatccaccgcgacagccagcgtgggccgcacccggcctgctgcatggaaggcgccccgcatggtggtctcctctccggtggtggtggccgcaaagacgcccaccttcgcccccttctcccgggcccgcagcagagcgtggagcacggtataggcgcccaggcggttgtccagcccccggccggcgatgcagtcgttctccagctcgtccacggcataggagtaggtgacgaaatccccgggggcgaccagctccagggcctccgcccggctggtgaagccacagtcgatgtagagatcggtcagctcgatgtcggtgcgcacctcgccgttgcgcagcagcaggcccataacaccggtgagccgcttccgccccagcaccgtcacccgcttaccctgagccagtgccagacggatgccgccggccttgcccacctggaggtagccgtcgtcggtgatgtgggtcacccggaagccgatctcgtcgatatgtccgcacaggagcacccggaagggggatgcgctgttgatggaggaaatcacatcccccgccagatcggtctccacctccgctccctgctcccgcatgtaggcggccacctttttctgaagggggatctccccgccgctcaccgactcggtacggagcatctcatataaaaaagccttgttcatgaccctatcgttcctttctaacgccgaccggccatgcggtcttccctgcgcagcaggagctgaaagcgcactccgtcggcccagttggaggcccagatgtcccccttgtgaaactgcacaatcttttttgcgatgtagaggcccaggccgaagttgccgtccgcccccttgtagaacttttgaaacaggacgttcagagtcggctgcgggatgggcgcgccgtcgttctccacggtcaggaggtagccgccctcctcctccccggtcaactccatgcggatgtagctggccgcatagcgcaggccgttttccaccagattgtcaaagacggtctggagcgcagccgcattccccgacaccgtgaggccggccgggacgtccacctccagccggataccccgctcgttgccccgaaaccgcctgcggcactcctccatcagtccccggagctccaccggccggaagtcgctctgtttgcccagcatgtgatcgaaggaggagacatagagcagcttcctgatccctgcctccaccgccaggctctccttcatgatgatgtcgatggcctcggagccgtagatgccgtcctgataggcggcgcagcagttctggatgaccataatgggggtcttgagcccatgggacacactctggtagaaaaactcctcgtcctcgttgagctccaccacattgcgctgaatctgtgacagggtgttgacgagcgtcccgatttcgtcccggcgggccacctgcaagaccggctcactccagtttttgcccttgatgcgctccagattccctgccagccgctccaggggctcggtaatgcgccgggccgccagcttggcggcgaacaggtttgcaatgagcagcagggggaacagggcggccagcccataccactgtccgggctcctccggccggagcaggaggaggacgtacagcaggatggcggccaaagtgagtccctccgccagtgagaggcaggcccagagctggacgctcaggggccggtcctgcagccagtatctagtcgcaaagcgattcatgtctctcctccgtcaggcagtagcccaggccatagagcgtactgatttcgatgccgggcagcttcttgcgcaggcggcggatcgtgtcgtctaccacccggtcggagccataaaaggtatagccccacacggcgtccaggatgtcgccccgcttcaggacgtgcccccggttagccgccagatagagcagcaggtcgtactccttcaccgtgaggctgatactctcgctgccgcagtaaaccaggtgcttttccagatggaccgtgtacggccccacctggacctccgctgttttaggccgtccccccttcagcagccgctgaaccttgataaccagctcccgcaccagaaagggtttggagatgtaatcgtccccgcccagctccagcccggccaggcggtcaatatcctggttgcgggcagaaatgaagatcacatagctgttgggattcttcctctgtacctcccgaaagacggtgaagccgtcgatgtccgggagcataatgtcgatcacccacaggtcggtgggcttgtccagcccctgcacagcatcctccccccgcaggtagctgcggacggagtagccctccttctgcagatatttggtaatcagattgttgagaacggcctcgtcctccaaaacgctgatccacatgccgcacacacctctctccccaattgctcaggagcataataccaagcccgtaatactttgctattataccatattcccggggcggctggtagaggatgccggaaagaaagggcgccccccatgcgcggcaggtggcatgaggggcgcctcggctcagccgatcaccgtatagtactggaagtcccactggccgaccggggtgcggccggggccggaaaccttgccgtggtcaatgacctgggtataggtggtatagtagatcgggcagataaccatattctccatgaggacatcctcagcctccttcaggtaggcgtcgcgctcctccccggaggtcttggccgccatcttcacggcgttgtcataggcctcgttttccgggttgagaatggtatccccgggcacgccggagtagggcttgtagcgccagcggacatcgttcatgccctcggcggtgaagagggagagcatggtcatggggtcgttgtagtcggcgctccagccggtgaaggcaatgctccagtcgccggagttgatggtgttggtgaacaccgcgtactcctgcacctgcaggttaaccttgatgcccaggttttcctgccacatctgctgcaccgcctccacaatcagggagttgttgccgctgtcgtagtaaaggacgttcagctcggggaagcccgccccgcctgggtagccggcctcagccagataggcctgagcctcctccaccttggcggagtaggggtcgatttcgtactcctccaccacgtttccgttctcatccagcgcccgcatactctcgccggtggacagcttgaagggaggcgccacgaaggcggaggcgggtacagagccgtcacgcaggatctggtcggtgatggtgctccggtcaatggccagggacagggccttgcgcacattgaggtcgttcaccacgtcggcgtccatgttgaactggaagtagctgttgcccagggcgggctcgctggagaagttgggatcctcggccagcaggcggggaatctccgcgccgggcaggatggaggtgacgttgatttcgccggcctcatagccctggagggaggtggtggcgtcggagatgaagaggatgcgcacgccggccagattcacattatcggcgttccagaagttgggattcttcttcagcagaatgtgggagcccaccttgtactcctccagcatgaacgcgccgttggagacgcatttggcgggatccttttcccagccctcgccggtagaggacatatcctcgcggcagggcatgtaagtaaaccaggacaccaggttcaggaagtatgcggtgggctgcttcagctccacctggagggtcttgtcgtccagggccttgaccgccacttcgtcccggctgccttcgccgctgaagtactcataagcgcccttgatgtagtcggtcatcaggaaggcgtagggggaggccatctccggggagcaggcccgcttccaggcgtactcgtagtcgtaggcggtgaccggctcgccgtcggaccaggtcaggccgtcccgcagatagaaggtgtacacggtgtcctcaacgccgtcggcgttggccgagagctcgtagcgctcggcggatgccatctggacgccgtcccgggtgtcgcgcaccaggccgtcgtagaggttcagaatgacatggccgcccatgctggaggtgttaagctgggggtcccaggtcttgggttcctcgcccacgttgtaaaccaggtactccgaggatgcaccgccggagccggagtccgttccggtgggctgcgggctgtcgttcccgccgccggagttggtggtgggcgcgcaggccgtcagccccaggatcatggaaccggccagcagcatggaaacgagatgcttcgctttcataatatgcctcctttttcctcattcccccttgcgggggtcactctatggcaggcaaccgcatggttgcttcccacctcggtcagcggcggctcctgctcggcgcacaactgcgtggcgtaagggcagcgggtgcggaaccggcagccggaagggggatcgatggggctggggatgtccccctgcagcatgatgggctcgctcctgtgcgccagctccgggtcggggaggggcacggaggagagcagggcctcggtataggggtggagatggttctggtagatttcctcgctgtcccccacctccaccagcttgcccaggtacatgacgccgatgcggttggagatatggcgcaccatggacaggtcgtgggcgataaacaggtacgtcagcccgaactcccgctggagatcctccagcatattgaccacctgggcctgaatggacacgtccagggcggagatgggctcgtcgcagacgatgaactcgggattgaccgccagggcgcgggcgataccgatgcgctggcgctggccgccggagaactcgtgggggtagcggttggcatgctcccgcatcaggcccacgtggtccagcagttcatagacccgctggctcctctgctccttggtggtgagttcggagtgaagatccagcgcctcccggatgatgtccatgaccgtcatacgggagtctagggaggcatagggatcctgaaagatcatctggatacgcttgcggtaggggagcagctgggggccggtcagatggctgatatccgtcccgtcgtagaggatttttccctcggtgggctcatagagccgggtgatggtgcgtcccagggtgctcttgccgcagcccgactcgcccaccaggccaaaggtctcgtggcgcaggatatggaagctgacatgatccacggactgcactacttgttttctgcggcccagcaggcccatgggcttataaaagtatttggtcaggccctccagctccaggagcttatccgtcggcacgccgcatcgcctccttccgctgaacatactccggattgacgggggcctcctcgtggaggagccagcacatcgtccggtggccatcctcctggaaataggggggcatctcctccatacacacattcatgcagtaggggcaccgggtgctgaagggacagcccttcggcgggtgaatcaggttgggcggggtaccgggaatgggcttaagccgctgcttctccccgcccgtgacacgggggatggagtcaatcagacccatggtatatgggtgcttcgggtggtagaagatctcctccaccgtgccgtcctccataatcagcccgccgtacatcaccaccaccttgtcgcacagggtggccaccacgcccaggtcgtgggtaatcaggatcgtggtcatgtccagctcccggttcaggcgcttgatcaggttgaggatctgggcctggatggtcacatccagggcggtggtgggctcgtcggcgatgagcagcttggggctgcacgccagagcaatggcgatcatggcccgctggcgcatgccgccggagaactcgtgggggtagttgtgaattcgcttctcgggggatgggatacccaccatacgcagcatctcaatggcccgccgtttggcctcacccttgccgatgtcctcatgctcctggagcatctccatgatctggttgcccacagtatacaccgggttgagggaggtcatggggtcctgaaagatcatggcaatctccttgccgcgcacccggcgcatccggcgctttccgtaggagaggatgtcctggtcctggaagaagatctctccgtccaccacccggccggggtgctgaagcaggcccatgatggacaggctggtgacgctcttgccgctgccgctctctcccacgatgcccagcacctcgccctggttcacatcaaagctgatgccgcgcaccgcctttacctcgcctacgtgggtgaaaaaggaggtctttagatttcgaaccgaaagtaaacgtcttgacatatcgcaaactcactttctcagccgcgggtccagagagtcccgcagtccgtcgctgaacaggttgagcgccaggatggtgatactcatgatgagggcggggtagaagagctgataagggctggtgtaaaggctgggcagcgcggcgttggccagcgcgccccaagatgcctggggcttggagacgcccagtccgatgaagctcagaaacgcctcggtgaacatggcactggggatttgcatggtcagggccaccataatggggcccatggcgttgggaataaggtggcgcaccaggatcttccgggtgggcacacccagcaggacggcggcggagacaaactcctgctcccgcatagtgagcacctgggagcggacgatgcgcaccatgcccacccagtaggtcaggcccatggccagaatgattgagtgcaggccggagcccagcaccaccatgatgagaatgacatagagcatcatggggatggagctgatggtgtccacaatccgcatcatgatgttgtccacagcgccgccgaagtagccggcaatgccgccgtagagcacgcccacgaccaggtttaccagggcggccaccacgcccaccagcagggagacccgggcgccgtacaccacgcggatgaacaggtcgcggcccagggagtcggtgccccagatataggtcttgttcaggacggttttggcgggggtgatctgcgccccgtcgtagaacacacggaagcggtcgatcttgtcctccaggatgtgctcggcctcccgcagactcaccgtctcgggggcgtcctccccgtagtactccctcaggtactccacctccgccacggtgacgggactgccgtcgccgtgggcagcctcctgggtgataaactccgatttggcccggaagtacacgccgtaatccaccagcaaatcctttccgttgatctcatataggtaggtccgcccggctttgtcatccttgaccagggtggaggccccaagcaggtggccggagccgtcggtgtcaatacacttgtagtcgctggtgacatagacgaagctgttaccgcccagatcgtagatttccagctccggcgggatgttggcgtaccgcaggtcctgttcctcgtaggaatagggccagaacatgggcacaaaaatggcggagagcaccacaatcaccaccaccaccatggacaggagcgcggtcttgttccggcacagccggtgccagcagtcctgccagtaggtcaggctggggcccccgatggcctcggaggccagggcgtcccgctccgccggcagccagcggcggtccgtttccttcatactcatgcgcgcctcctcaatccagcttgattctggggtcgattaggacgtaaacgagatccacgatcagcacggccaggaccagcagtacggcaaagaacaccgtaatgcccatgatcagcggatagtcgcggtttacaatgctgtcggtgaacaactggcccacgccggggatgccgaatacggtctcaatgacaaaggagccggtgacaatggaggccaccatgggcccgatgtaagtcaccaccggcagcagggcattgcgcagggcgtgcttgtagattaccttgaattcggagatacccttgctccgggcagtgcggatgtagtcctgctgctgcacctccaccaggctggtgcgggtcaggcgggtgatgaaggacagtgggaatgccccaatgaccagcaccgggccgatatagcccgccacctcgtccacaccgaaggcgggcacaagacccagggttttgctgaagagaaacaggaaacccgtggccagcacaaagctgggtatggtggagcccagggtggacagcaccatgaaaaaccggtcaatcagcttgttctggcgcagcgcgcacaccgagccgaacaggattccggcaaacaccaccaccagggaggcgtagatgccgatggtcagcgaaaaggggaagccgtcggctatgaccttgttgacagtcaggccggccttggtgtaggagacgccgaaatccccccggaggaagttgcccagatagatgatgtactgcttccacagcggctggtccaggccgtacttggccatcatggccgcctcaatttcgggattgggcatcttctccgcggcaaaggggttgccggggatcgctttcatcagaaagaatgtgatcgtgatgataaaaaagatggtgaccaatgcggataaaattcgtttcagcacatacttgagcatacaaactcctttctgaacagacaatgcctccccggtctgtcccggcctgatagagaatacagtgctttaatgtgttacagaatattataaatcaaaattgtcttgagaatatcgacagtttatgtgaaaaatcacatatttttgcgttccatttcggtctgcatcaggtcgggatggggcgtaacatgccagatatggacatcccggtagtgctccagcagcaggaagtaccagttgctgtcgaacagcagcagccccgcgagggcgagtgaggccagcccggcggccccaccggacaggccgggaagcagcgccgtccccttccagatgtcccacaccgccgccgcccccaccaggccgaggcagagcaggccacaccgccgtccctccggccgggccaaggcgcgcaccgcacggcccagccagagcaggccaaacaggcacaggaaagcccacaggcaggtctgtggccagcggttgtcctcagggaccagccgggcgcacagaaacaggagccccagcgccaactgcaccgtaagctgcagcagcccgcgcagctcctcgtagaaggcggcctgggccggatgggcaaaggatggcccctcctcccgggcagacagggtgcggagtagcgccccgccgcagcctgccgctcccccggcctggagggcggccgccagccccgccccggacagggagaacaggaagcggctccggtcaaaggcatccagcagcaccagcttgacggcggggatcaggttgggcagattgccgagcagggccgccgccagcaggagcagaaagagcagggagagcaccgtctcgccccgctcccccacaagccggcagagcagccacagggccagcagaaccaccagccagggcaggagccccgcgcctctcgccggggcggaaggactggccaatatccggaacagcagaggcagcatgccgcacagcgccagtgtctgaagccagcggagcagacggcccagtcccggccttgcgcgggcccttttgcggcacagtattccctccagcagggcggacagctcgacccgcccgccgcagccaggctggtagtagcgccacagcccggccagcgcccccagcgggtgcagccagagcagggagaacaccagataccagaacagggctcccgcccctcccaggcagagcgccgccattgtcagtatccaggccatggcgccgctgtcgccggggagccccgccagaagggcgcgcacgatggcgcggcgctgccccggggcacactcctccccgagaaagctccacagggaatgccggtacggtacctcagcaaagatccgccggtatccggcccagaaaaaaagccccaggcaggcggtaaaaaagagataaaatgggttttgcagcatctgcgtccctcccaggggcggctgcggccggtaaaaatctgttttctgaatcataacacacttccccctgcttcttcaatctggatcgcgcttcccctgccccggctgtgggcggccacaagggccgccctacctttccggggttccgtctccggcgggctatcttgcggcacttgaagcctgtaggggcgggtgcccacacccgcccggagctgaccggtggcccggaggggcgggccgacgtgggcgtcggcccctacagaggtctgctgcggtaggtaccgcccggccaaaatgctccataggggcggggcttgtccccgcccgcgggcggccataaaggccgcccttacttccggggttccgtctccggcgggctgtcttgcggcacttgaagcctgtaggggcgggtgcccacacccgcccggagctgaccggtggcccggaggtgcgggccgacgtgggcgtcggcccctacagaggtttgctgcggcaggcaccgcccggccaaaatgctccgtaggggcggggcttgtccccgcccgcgggcggccacaagggccgcccctacttccggggttctgtctccggcgggctgtcttgcggcacttgaagcctgtaggggcgggtgcccacacccgcccggaactggccggtggtccagaggtgcgggccgatgtgggcatcggcccctacagaggtctgctgcggcaggcaccgcccggccaaaatgctccgtaggggcggggcttgtccccgcccgcgggcggccacaagggccgtccctacatttccggggttccgtttccggcgggctatcttgcggcgcttggacgtaggggcgggtgcccacacccgcccacaggccgttcggcaggacaaggcccccgcgtccggcggtacgccgtgcgcgggggtgcttttatctccagaggaggtaatcagaatggcaaattatacacagcactatcacctgcaccagtgggagccggaggacagcttcctccgcaccgacttcaacggagattttcagaggctggacgaggcgctggcgggactggatgggcgcaagccggagctgcgtctggggcggtacaccggggacgggacgcagaaccgggcggttgcgctggggtgtgccccccgggcggtcctgctcttctgccgggatcgggaggctctgctggcctggccgggcgcgccctatgtctacgcttataacaaccggcccggcaatatgctgattctgacggagaccggctttcaggtgcactacgaccactacgaggtgggcctcagcgacaacgactttctccccgtcaccaacaaggcgggggagagctaccgctatctggccctggtatagcagagagcccccggacccgattgggtctgggggcttaacctgtcgaaaggacgttttgacagagagaacccgccgcgcaaaaatgcggcgggttctccgatttagggacaggcttgattaccagtccagatccagggtcacggtgtaggtagtgccattgatggtcaggttgttgggcgtgtaagcggcatcgttgcccaccagcatatactgagcagcgccggcttcatcgtagaatgccaggacggcgaactcagtagagttcttgagatcattctgactggtggcagatccgccggtgcagtacaactgcgcaatggtctcagcggggttggccgggtcggtgccgaaaccgggaactttggtattcacactcgttccggtgaccggtccgctcacggtaatcgcgttcgagccggtggccacgatgtcgaagtcaaaggtcacatagccagagttcaccagatccacccaatagccatatcgggcaggatcctgcaccttccagtactcagtgtactccaggtgagcattcttgtcggcagtcgtcacagtgacgtgattgtccgttgtggtgcaggtgtagttgtcaccgttcttggtgtccttgatcacccaattaccagtactatccacctctacttcgatgtcggagacgctgacacccagaacctttgcggcctcagccttgacagcatcgcgcttctcggcaaaggtggcatcctccgcaccggtaacggaaatattcagtttccgagtcatggggtcaaactgcacggtgatgctctcgttgacgataccatcgtcacgatgctcctcgtccacttcccagatccaggcggtgcggatggcgttgtcatcctcgacaatgacggcgttcaccttggtattgtaggggaaggtgcccagggcggtcttgtcctcggcggtgtccacgtcggtgacatcccacacgttggccttgccggacagggcgatgtagcccttcaggctgctgtccacagtgccgttcttcagcagcttggcggtaccggcgttctctacgtcgtcgccgatgtcataggtgccgtcggcattctcggcgtaggtgtaggccttcatgtagctggcctcgtcgtcccagtcgtggccgccgtcgtcgtccacctcgatggcctggacggtgccgtcctcaaagacaacgttcagctccagcagatccttgccgatggcgttggcggacagaaccagcatgtagttggcgctggtggccttggcctcagcctcgaagaggatcacgtcggccaggtcggtagcctcataggtcttgtaggaggtcttgtccagaacggggtagacctgaacatcgacgcccggattcacatcgctcatgtggtcccagccggtggccacgccgtactcaatctcgcccttggtgttcgtccagtagtagaaggcaacggtgttcttgtccacggcgtaggtcttttgagtctgtccgtgcgccgtcacattgatggagccgcggccgccggtgtagccgttcatagccttatactgaaggctaccattattagtggtgtccatccggatgacgttaccgtcgtcacccacaccggcggtgctgtcggagttcacggtggaatcgatctcgctgccagtgcccttgaggctgttgccctggaggacgctcttgatggtcagcacgtcatcgtcggacagggtgtaggtgatgatggagccagcggccacgccggtcttgttgtaggagccgctgccgggctggttaacgtcgcgggtgcccaggtaggtctccagcttcacgtcgttggacttgctattgacatcattagcggcagtaattccagtgatatcctccatcgccttggcggagttcttccagttgatgctgtaggtcttgacggtgccgtcggtcatgaggatcttgacctgaccggagcggtccagggcgttcagggtccaggcggagtcgatcacgagggcatagttggtgacgatctcctcagcggggcggacggcgatcacatagccgttggagtccaggacaaagtcgtagctgttgtcaaagccgggctcgttcttggcgtcggcaatgtcaaaacgggtcagatccacgtccaccagggaggcggcgtccagaatgtaggactggcggtactcttcaccatccacggtgataaagagctcgtcggccttgtcgcggtccacgcgggtcatcttgccggtgacaacctcgggggcggagatgtaggtgcggccgccgtactgcacgtagaggatcaggtcgtcggtggtcacctcgtcgttgaacactacgtcctcaaagtcctccgtctcagtgacggtcttgttggccagctcgttgttcttgtcataaccgggcgcatagaaggagattgtctcgttcttctcgctgtaggtgcgcacctcggacagagtctcgcgggtgaacagcacgtactcggcgtcgccatcgttgttgttgtcgatgatctcaacgtccacaccgttcaggttgaacttgtcgctgttgttggcggcatagctgtagtcgttgatcaggttgtgggcatcctcttcggtcttgcagtagccgtagttcacgtagaactcggtgcccttggtgacggccacgccggtgcccttcaggtaatccttcacggtgctctgagtggcagcggtggcgttgatcacgttcacgtcgtccttggtggacacgcccagcaccttggaatcggacaggatggtggtcttctcgatgtacatggtcacggtcttgcccaggaagtcaacgggggtgtccacattgaaggcaatcttaccggactgggccacgccctcgtccttggtggtgttggaggtggtggaggagtacagaaccacgttgtccagcacggtcttgccatccttcagagcggagtcggagtcggtcttgtccagctcagcccacttgttgcccaccacaacgccctccaccttgtacacgccgtacatggaggacaggatggtgcgggcatcggagtacgccatggcgtagccgttgttggtgtagctctcgatcatctccacgtccagggcgttgtagatgagcagagcggcgttgtcgcggctcagaggctcggccacggagcccttgaagttgcggaagatgcccagcttggaggccagggcgttggtgttgatctcccagtcggtgccggtcaggccctcgatagcgggatcgtagccagcggccaccagcagcatcttggcggcctcggagccggtcacgcccgcgtcggggtcaaacttgccgttgccgcggccggcaatgatgccggtggtgtagcagtagttgatgtggcccttggcccagtggctgctgatgtcagtcaggccggaggggctgttctcatacagggcgccgttatccacgccctgattcatgatgacggagatcatcttcgccatctgggcgcggtccacgccctcggtgggggcataggagccgtcgggctttccttcgatgacgcccagcgtcaccagcatggaaacggcgtccttgttcacgatctgatccttatcggtgagatcgttgtagctcgcaacggaggcggagacaaccatcatgccgatgagcatgatcgccgccagagccaggctgagagcccgcttgaggtttctcatttggatttcctccttctgaattttgaagcccaggggcgtatgacgccccttgcaagccatgaaaaaggagggattccccccacatgcagttctaaataacacaaaagagcggcaaaaagtggcgttggtagacctctggtagacacgccgggcatgccaagcgcaaaaaggcccggaaccgcaacggttccgggctgcttttggtagacatttggtagacttaaacttaacacaccatccaataatataatatattgaggtttccgcctgcgaactatatcattcggtacagggttctctatatagagcaaggttcggcctctgactttcatcctctatgccattttgggttatgcacgaatttgattgtccaagtttttactatcgtccataacgacaaattccctgcaattttaaaaaggcaaacagggaccgacttttgaagaagtccagaatacggttccaaaattcgaccctcgttcattatgttttgggctcttatcgggatatatttgtttttacaacttttaattcggtcaaatatctcaccatatcggctatttttatctgattacagaaacctgccacttcaggacaagtggagcttttccgcccgttgccactgctccgacggcaaccacttgtccatagcggtattgacgctgccgtagatggcatggatgtcttcatccataccatctacggcagccgagtacctcatgaggtatcgcagtcttttcaagtccatactgtcattgtccatgttggtgcagtcattactgaatgaagtccttctatagcttctgctgcttcggtgacagggcaatccgcttggtggagtcgttctgcgccacgtcggacatcttacagttgaaggtgctcctgatcaggatatcctcctcgtaggacatctgaaaagcgggtttcacaatgccgcgaacgctcgtgatgtgctgtaccccttgccgtcgttctgaaatttcatatttcttacgcaacttacccaaagtctttgcgtaaacagtctggcgcttgccggttcctccgctgtttaatatgttatcaatagtcataaaacacccgcatatatctcttcatagacattgaaccccttcaaattaggccaatgaatgaggatatcagcgccaagctggcttcgggtatcagtaggtaatctggtacaatcagctctgcctgcacgcgtcctgcaaatcagagaccagcacctttttcagccgtgcatagcgggggagggagtgttcctgcggggcccgagggacgccctgaatcagggggagcacgtagtcgatgaagggctgctccaggccgttcccatcggcgttgatccaggcgcggggaaccgtcttttccgcgttggccacaatatccaggggttccagcacagtctcgcagcggtagcctccctcccgggtgcaccggaaggccaccatcttgtcggaatacccggcgaccgcagcctccacggccgccttgcccgccagaaacgcctcgtcgatgtcggtctgggacgcgctgtgggcgccgcagcgctggggtagggacaactcgatgccccgcaccttggcggagggctcccgctgccggagaaggtcggccagcagcgccgccagccccccaagctgggtgtggccgaagccgtcgttggcggcggcggaaactccttcggcgatgaaggcgccgtccgcccggtggattccctcagagaccgcgatcaggcacttgttcttcgcctgatagacctggtggacatccgccagaaagcgttccatgtcaaaatccacctcgggaaggtagatgagatccgggccgtagcccgcccaggcagccagagcagccgagccggccagccagccggcgtggcgtcccatgatctccagaacggtaatggttccgttgtcgtacacatgggtatcccgttggacctccatgcaggtggtagcgatgtaccgggctgcggagccgaagcccgggcagtggtcggtgccgttgaggtcattgtcaatggtcttgggcacgccgatgacgcggcacgcatagcccacggactgcatgtacttggagattttgttgcatgtgtccatggagtcgttgccgccgttgtagaagaaatagcgcacatcatacttgcggaaaatctcgagaatacggcggtagtcggtgtcatcctggctgggatcagccagcttgtagcggcaggagcccagcgcggaggacggggtgtaccgcagcagctccagctccccggcatcctcctgccccatatcgtacagccggtcctccaggacgccctggattccgttggccgcccccagcacccgggtgatgcagtccgtgtccagggccgtgcggatcaccccgagcgcgctggcattgatgaccgcagtggggcctcccgactgcccgatgatgcaggctcctctcaattcactcatgaattcttccccctcatagcaacaagtttcaaagtttatggtttcggatatcagcagctctccaagtgcccgcaataaatggttacacaagcgccccggattctccaggttccaatgccaaccgttccgccgcaaactggtagccagtctgtcctgcccgaataacccatgcaagcgctgtgccaaatatttcattgagcctccgaaaccatgcccatatagccattggcatttactgcatctccttttgactaaaaatcacctattatataaagatttattgaatttgggatctttcagcgggtttgccacgtaaacggcgctctctcagaagcaacaggccagcccgtttctcagacggcagccgttggagccttgcgcccctgcaaatatttgcaaaaacgcaaaagctgagccccaaagtatgaaggggcgtaacggcccataaggaaggttatttctattcaagacgggttgcctctggtagttatcataggcattggcaaccaccgccacaaacagttcagcagtgacggaactgagcatacgtaccttcctggtattgactccagctagacgagtaacccctcattgccgccaattgagtagttgtatcgtccgaaataggtcttgtccctctggaaacagcttatgatgagggccgcgaccataagaagcgcgcagatgggccggggccgaactttctctggccggtccgcttaaatatatcagggaaatcaaaataggtttctgatttgaaggatacataggctataagtcatggtagccaccatagatggagatgatgaagcaggagttcaggctcattaggtttaacgccgtgaggaaccgggagccgcatatgcaaagaagataatgacttcggtgggaaggataaggatgtaaagctgttctaccaattttataacagagcttcaagggccccaagggtcaggtgaatgtgcccgttttcctcagacttcacgatgcaacctcgatgtgaagctagtccagagctttgtcacgccaacgcctacagtccgatacttagggctaccggtatgtggtttctccctcagcccccggtggacgagatattactcggcgtattactttttcgcctgggttaggcgctttgattgggagactgtaggtgcgcggtacaccggcctatgattacaaaatgccccactctcctcctccctaccaataacaaaagggaaccccgccgcagcgacagggttccctcttacctcttaatattgtagtagaaagcaatattgccagaaacgtgatgtgcagccagagcttatcctagctgcgggatgtaccagcttcctttatcgttttctcacctgacagtgcaagcaacaccgctaccagggtgccatccctgcgccacttggcaaatctggcgtatacagattgccacggcccatattttcggggcagcatccgccaatgagcaccgtttcgcaccacccagagcatgccgttcagcatagtgcggtcattcttacggggacgcccccgtccatcagccctggggggaggcagaagtggctttacccgtttccactgttccttggtcaggtcatatgctctcatgggtgctttcaccatctctatccagtctctgcaaactcaggcttccgcttccgcaatgctttattgcagcatagcagacacaaaggtatccaggtccatacgcacaaaataatcctccaccggccagtctttcaatgcctgccgaagagcgccttcctccagcggagttccctgaaggtactccgccagtgcgtcgctgtccttccggacgaagtaatcccccctgaaggcaagccgggtaatgttccccttctccacatccatatgaatctgaagggttccacacccctccacccgccgctccttccgaatgctgcaagccggggaatggccgtggttccactcccactggctataaatccgcttccgcagttcctccacctgttccagctcctgcggtgagagctgatactttcgcatggaaaagcaccagaacattcgttcccgcagggccgcccagaaatcctccaccgtcatttggggatcatttacatagggcttgatattggtgacccggctgcgcaccgatttcagtcccttggactgaattttgtcgggccgaacggccagtgcctggcccaccacctccagatcggagtcgaacatcagggtaccgtgatgcatgacccggccctgccgcagatattgggcgtttccggaaaactttttgtccccgatagtcatgtcgtttcggccattgatctgagccggcacccccatctcccgcagggcgtcgaccaccggccggcaaaaggacgagaagtcgatcattccgccctgacaatctctggccacaaaagtaaagttcagattgccccggtcatgatataccgcaccgcctcccgacagccgccgaaccacggtaataccgtgctcctttacataggtactgttgatctcctccagaacattctggtatttgcccaccacaatcgtccggtcgttctgccacagcatgaagcagtcctctctggggcccagctggtcaaagacaaattgctccagggccaggttccaggcgggatccatgctggcgctttccaggtaatacatgaccttccgaacctccgtcagctctccagatcgtgaatctcgaccttgacgcccagctctcgtccggtgtcaaagtactcaaacgtctccactccggccacatgtcccttcatcacactggcaattccccgctctgccatcgtctcgcggaacgcctggttgtctgtaagaatggagatatggtgaatatggccctcgccgtgctccttcaggtgtctggcgtagtcgctgtactcatccagcggctgaatcagctccagctgcacgtttcccgccatgcacagcgccagagacaccttgaagtcctggcgctttccatataccatcagatcctcagcctcgtccttgaaacctttttttccgtcccggatctcccaggggccgatcccataaagtttctggtagcgatctaccatagcatacagatctcctgtcacgatgccgatctgggtaatatttttgatttcagcgctcaagatgcagctcctcctgttccatttcttttgccagagcgaccgccatgcgcaccgcgccctcaatggcctgggcgctgtggtcacaattcatgtggcacacaaaatggtcgttatatgtatcctgaccgatccggtgcgccagctcttctatcggctcctcgaacaactcagccacagagaccggcagacccacctttctcccgaaacggatcacacgccggatctcctgctcctgatacccctccaggatcagctgaatcaccaggcccaccatcacccgctcgccgtgcatatagtcgtgcccgcccggcagagaggaaagatagtcgccaaacccatgcgctccggagcagcccgtattgactccgccgatgccggagaggaagcagttggcctcgatcacccgctccagcgcagggatcacaatatggttttcggccgccagccgggccaacatcccattttccaggatcagctcccggcagatccggcacagggccactgccgtgttggacatttcatgcccgctgcccgcgcagctctccatctcgtaccaggtcgccagggcgtctcccatgccggacaccagcagacgcaccggagcctgggccacaatggtggtatcgacatagaccagatccgggcacttgtggaagatacggtcccccacaatctcctggccgttctcggagtaaagcacgctgacaaaggtacagggcgcgtcggaggccgctgccgttggaatcatgaccatagcccgtcccaagtccatcgcggcggaacgcacaatgtccatcactccaccgccgccgatggcgcacagcacctgggctccgctgtccgccgccagctttgtcacccgctgtatctccgaggcgcagggcaccccggaggtgagctcaaactgtatctgggcatcagtccccgagaagctatgcgccagcttttcctttgataccctcagggcggatttgctgccaacaaacaggaaggatcgtccgtagcacatcgtatgctccgcgaactcctccagcgcgtcttttccttgaaaataggctcccggaaatttcattgacaagctcatatctcacgctccattttgaacatgcagggctggccgggttggtccttctccccccccccggccagtctgctgtatttacgctctgttcgcgttggcctctaccttggcatacacgttttcagcgtaatttgccataaagtccacatagtagtcgtaatttacctcggcattattgcgaaccagcaggttctgatattcctcgtcggagatggtgtgggtggaaagtgcctcgtcactcaggaacttgtagaagtcctccgcattgtcagaagtcactgtgaacagctccaggctgtcaaagtagggggccttgccctcagaatccttgattacgtttccatccaggtaattgaccaggagggtaatcgccactccgcagcttgcaaacacgcctccgctgcatgcctctacctcaccatccataataagctggcagatatttggactgatatcagcgccgtaaatcttacacccctcaaggccgcgggacttgacaacatccgcggccggcgccacgtagtcattgccgcacgcatagacgcagtccacatcgggataggcggtcaagagatcatttgtcttctgcactccttcagagggatccgcggagtgagagacaaacagcacctctccgccgccagcctcaaacgcctcggtaaagccgatgatacggcggtcgtgggcgtagtcgccggaagcgccggcggagatcaccgcagtcttacagccgtcggccagcgccagctccgcaatgccggccccctcgccctggggactgtagaccaccgttcccacatagtactcgtcctgctcaaaggtcgccacatcctcatccttgggcgcacacgcaaagaacacatacggtgtctccgcatttttgcaatactgggcagctaccgggaaaagcgtctcggagatgcccagaaatgccaccccgtcaggagcagaggccagttggttctggagctgggtgatcgacttgtcagcggtaaactcattgttggttacattcaaagtcacaccgagggcatccgccgcgttctgctcataggccgcatttgtatcaagcggatagacacccgcgccgaagttgttggtggcgatggtataagaggtattgctgccggtattgacagcggggctgctctgtccaccgccagactcccctgtgggggcgcagccggaggccagcgcggaaagcattgccaggccgagaaccaaagcaaggattcgtttcatgtgtttccctcttttcatccggttttatactcatatagcttgcggcagtcacacatcatgttaaccgcgctccacatgccatcactccagaaggccgctctgcaccaccatgtttgcggcaagccgcctctgggataaggctggccagagctggaagggcccggccagcccgctcaggagacagcgctcttactgtgcggcatttgcctccacttttgcgtaaacgttctcctcatagttggtcaggaagtcgtagaagtagtcatagtccacgtcgggattgttgcgaaccagcaggttctgatactcctcgtcggagatggtgtgggtggccaggttctcatcgctgaggaactcataaaagtcctcagcgttctcggcggtcaccatgaactgggttaggttatcaaagtagggcgcggtgccgtcggcgtccttgatcgggttgccgtccagataattgatcagcagtgtcaccgccagactgccacagacaaactcaccgcccgtgcaggcttccacctggccatccataatgagctggcacacagaggggctgatgttggagccgtagatcttgcaatcggtaatgccgcgggacttgatgacgtcggcggcaggggtgatgtaatcctcaccggtggcatagatacagtccgtgtcgccataggcggtcatgtagtcattggtcttctgtacggcctcggagggatcggcggagtgggagacaaacaggatctcaccgccgccggcctcaaaggtctcagtaaatccgatgatgcggcggtcatgggcatagtcgccggaagcgccggcggagatcaccgcggtcttgcagccgtcagccagcgccagctcggccagccgcgaaccctcgttcttggggctgtaaatgaccatgcccacatagtactcatcctgctcaatcttttccatatcctcatcggtgggagagcaggcatagaaaacatagggcgttttggcgttcttgcaatactgcgccgccacagggaagagcgtctcggagatacccaggaaggccaccccgtcggggctggcggccagctgattttgcagctgggttataaccttgtcggcggtaaactcgttgttggtaacggtcagggtcatgccagtggcgtccgccgcggactgctcgttggccaccatcatatccagaggataggcgcccacgccgaagttgttggtggcaatggtataaccaccctcgccgcccgcgtcagccgtgggactggtctggccgtcgtcggtctgatctgcgggcgtgcagccggcggccagtgaaaagaacattgctgcgctgagaaccaatgcaagaagtcgtttcatgtgtttccctcttttcattcgtttttatatgcgcatggcttggggtggataagacgtctcttatcctcaattttatggtacatgccgcatgtgcttcatgtcaattgcaaccggcatgccagcctccggcgttcaggggccggcacaccaaaggccttgtgtcccgttacgtcccaggcagtctccctctgcctgcgtcctgcccgcgggcggcttttgggcagaaggaagcttgcattcgtgcaattttttgcacctgtgcaaacagggccccaataacattgccggaatttcctccacgctcagatctccgggaaatacttggcgtccttttcagccacccaggcgtgttcaggtacaaccgtggtaaccatgggatcgttgtcgcgcagacggatggcccagatatagtattccgcatacccgggggcagtggcctggctgtgagtcacgccgtgggccatgcaggtggcgtcattgtggtgaactttataaacggtgtctcccacctcggcatagccgtagccattttcgggcaggaacttatagaagtagatctcaggctccacgtgggtatggggggggaagctggaccacttgccggggtagctcaccacctcgccgatgaagaagtttgtctccggacagttggagcgatccaggaaggtgcgcacgatacgggtggatgcctcgttcatcaggccggcgccccggagttcagagccgcacagcagatcctcgcccttcatcagcttgggttcaaaatgcttgggatttgtggtgcgctggatggagacttcggccttgtcagactggcacatcagctccacagcggtattctggggcacatggagcaggatgggatcctcatggaagcaggatttgcgctccacggtctcctccttgtccgcccagcggaaggtaaccttgcccgtcaccaggacgtaaatgcactctttcggctcgttgtagctgacagtatcgcccttttccatcagcaactcgccgaagtccatgttcatgtcggaggcgtcgccctccacaacgatgggattatatcccctctggaatccggaattggtgagtttcatataaattacctcctacaaattttgattactgattttttcgcgcgatcgcttttcgcgccttttcgtaaatggtcttggcgtccagctggtagatttcccgcaggtagtccaccgtgcccacctggccaaaccggtccaaaactcctacccgctccagcggcacagggcaggtctccgccacaacttcggccaccgcgctgcccagaccgttgtaaatgctgtggttttcggccgtgacaatggcgccggtagagcgggcgtagtgctccaccgcatcccggtcaatcggcttgagggtgaacacattgaccacagccgcgctgattccctcccgggccagctgatcggccgccttcagcgcctcggccacgcacacgccggtggccataagggtcacatcagtaccggggcgcagctcagccgccttcccaatttcaaaggtggagccaggctggtaaatttgcaccgcgttcttccgggacaggcggacataatatacgccgttggccctctccagttggcgaatcacattgtccagcatgatggagtcggtgggctcgataatggtcactccagggatatccctcagggagcccatgtcctcaaagggcatgtgggtggcgccattcatggccgcagtgataccgggatcgctgccgatgatgcggatgttggctttggcaaaggcggcagacacaaaaatctggtctaagcaacggcgggtggcgaagcagccgaatgtgtggcaatagggcaccatgcccacggcggacatgcccgcagccacgccgatcatgttggcctcctgaatgccgcagttcaccgtccgctcgggatgggcctccccaaatggtaccgtacccacagaattcattagatcggcgtccatgactacaatcctatcgttctggtttgccagatcaatcatcgtttggcagtacacatcccgcatggcctgcttctctgtttcaagcgtctcacagatcctgtacgacatttcagcacccctccttctccagccgtgcaatggcctcctcacactgctccttgctgaatctcatgtggtggttatacttgatcccctccgcgaagaagcagcccttgcccttttgggtctggaggacgatcatagtgggcttctcctgctgatgcttggccagggcgatggcatcatagatggcgtcgacgtcatgcccgtccacctccagggcgtaccagccgaagtcctggaatttctggcgcatatcccccaaatcgcagatatccttggtatagccgtccagctgctgatgattgtagtccaggaacgcaatcaggtgggacagcttgtgctgcggggcgtacagggctccctcccacacctgtccctcctggctctcgccgtcgcccagcagcaggtaggtatagttgtcctttcccagcattttatttccatgggcgatgccgatggcggtggacataccctggcccagggagccggtgctcatatccacgccagtcgtgctgttgcggtcgggatggctgggaagcctggttccgttggtattgatggtcagcagctgctcgaccgggaagtagcctttcagcgccagcgcggcgtacagggcggggccggcgtgccccttggacatgacaaagtagtcccgatcctcccactgagggttcttcggatccacgttcattacgccgccatagagtacacccagcacatctgcggcagacatggcgccgcccagatggccgaagcccagttcgcccagggccttcagcacctggatgcggatgttttttgcaaacagctccaggtccttatgttgtgtcatcgtacgttacctcactttctcctctgcttaaaagcgctccagcgctttacccactttgatgagatttgtgataagcccatcgttataggccttcatttcctccgccgtccacgtctgcatgcccacgccgccggtcttgaatcccagctcgccccgctccaccttctccttcagaaggggcgatggttcgtgggagtcctccaggtagctatacagataagaggaaatactcagacacagatcggcgccgatggcgtcaatctgctcaatggggccgatggtacccaggcgcattccgaagctgtatttgacggcatcgtccacgtccttggggtctgcaatgccgttggcaatgatgctcacagcctcacgccccagggcgttctgcatccggttggcaatgaagccgggcacgtctttttttactacgatgggctttttgcccgcctcgcgaagcacgtcacacaccgcatccaccgcatggtcggacacatcggcggtacgcaccacctctaccaatgggatgaggaagggcgggttccagaagtgagtgcccaaaatccgctctctgtggacggacttggaggcgatctccgtgacgctcatggcagatgtgttggtgcacagcaccgccccaggcttgcacgcctgatccaggcgcgcaaaatagttctgcttgagctccatgttctccagcacgcactcgatggcgaagtccgcctcacgggcagcctcgtcaaagtccagcacaatatcaatgcgcttccggatttcgtcacaccggtcggcatccaccaggccgttttccgccaacagcttcaggttatcctcaatgaccccggcggaggtctgctgctccctgacatcaaaggccagcagcttcacggggaaaccggtcaccgcaaactgaagcgcaatgccggttcccattttgccggcgccgaacacggagatcttcgccttgttttccatatcattcatcctttccatcagatccgctcaaataccgcggcgccgccttgcccccctgccatgcagaaggccaccagtccgtagcgcgcccggcgccgtttcagctcatacagcagctttgccgtcagaatggcgccggtacctgccagcggatgtcccagcgccagcgcgccgccgttgacattcaccttgtccatatccagtccaagctcccggatgcaagcgatggattgtgtggcaaacgcctcgttcagctcgatgagatccatctcctccagggtgagtccggtcttgcgcagcaccttccggatggcctccaccgggccgatccccatgatgctggggtcacagccggtaaccgcaaacccccggaacaccgccaggggctccaggccctttttctccgccgtctcccgatccataagcaccactgcgccggcgccgtcgctcatcggagagctgttgccggcggtgcataccccatcaggctcaaaggcggtgggcagtctgcccagagtctccatggtgctctccggccggacgcattcatccctgtccaccacggtggtcttaccgcgctttccgggtaccgtcaccggaatcatctgcgcgtcaaaccggcctgccgcctgcgcggcggccgcctttcggtggctctccagggcgaaggcatcgcactcctcccgggtgatgtggtactttctgcccagattttcggcggtagtacccatactgacattgagcgccccaggggcagttctgcgaaccagccactgcggaggcgccacctgataggccacccgggccttctccatcaggtggggacggttggagtcactttccgttccccctgccaccacaatgtcggcctccccggcttcaatcatcagcgcaccgatggcaatggcgttgaggccggaggagcactgccggtcaatggtgatggcgggcaccgtaaagggcaggccggcctggagtgtaaccacccgcgccaggttggcgctgtcgttgttgcccaggttgccgaagataacctcctccacctcttctccctgaagccccgcccggcgaaccgcctcggcgataaccagcgcgcccagctcgggggcgcctaccgctgccagggctccccggcaccgccctacgggggtgcgcaccgcagagacaattaccgcttcccgcttcatgctccttcctcctcgtgttcccggtacacccgggccttctcctcgcccttgagcacgcgggtaattcctgcggccagagcctccatctcaaattccccggggatcaccgccaccggagcaatgaagcgcaccttccggcgcagcttttccaccagcagctccgaattggcaatgcctccggtgaggacaactccgtcgatctctccgtccgccgccgccgccaggccgccgatgcatttggccgtctgataaatcatggcctcgtagatgagtgcggccttcttgtcgccggccctcaccttcgcctccacctcccgcacgtcattggttcccaggtatgcggtgaggccgcctttgccccgaaccatggcgctgagctcctcaaaggtgtactccccggagcagcataccctggcccatccgatgctgggcagtccgccggcgcgctcaggcgagaaggtgccctcctcatcggtcatgatgtcggcaataacccccctcttgtggaggccgatgctaatgcccccgcccaaatgaaccatgataaggttcagttccccatacttccggcccagccgctgtgcgtacatgcggcccaccgccttggtgttgaggatatggcccatgctcagccgcggcaccagggggcagccggaaatccgggaaaccggctccatctcgtcagcggtattgccgtcatagatgtaggccggaatatggagccgtttggccatatccagtgcgataatcgcagcggtggtggaggcatgttgtccgatgggccggtttcgcagcacatcgatcatctcatcgttgaccacataggcccccgtgtgaatgggcggcagggagccgccccgggccacaatcgcggtcaggccggacagatcatagtcaatctcggccaaaaattcctccaccgccttctggcggaagggggcctggtcggcggctctggcgtaccgcgccacctcagaggccgggtgggacaggctctttttataccgctctacgccgttctcaaaaatcgaaatcttggtcgaggtggaacctggattgatgatgagcagcttgatctcctgttccatatgtaagctctcctttccgtgtcacagcttctggctggcaatcgcccccagcagaatggactgaaatttatcctcctcggtagcagagcgggagcacagaatcaccggcgctctggcccctactaccacattggcgctgcgcgcgcccatgaaaagcatcatcttgcccatcatgttgcccgacaccagatcggggcagataagcaggtcggcatcccccgccaccgggctgtcgtagcccttgattttggccgactcaggctcaatggacaagtcaatggaaatcgggccctccacgatacagccggtgatctctccccgctgatacatctccttcagggcctgggcgtctgtgctctcctgaagtttgggattaagggtctccgccgccgccagcacggccaccttggggcactccacccccatgctgtggaatacctccacggcattctccagaatctgctttttctgggccagatcgggctttgggttaagagcggaatcggtgagggcgagcagcttgtggtagaaggggttttccacaaaggccacctgagacatgagccgtccggtacgcattccattttcccgggcgatgaacgccttcatcatggtgcgcgtctccagtcctcccttcatcaggtagtccacttctccctccagtaccagccgggtggccagcgtcacggccttctccggttcatcggcctggtgaaagcgcacgccctccgtgctcagttgatgctcctccatcaacgcccggatcttcttctcatcaccgatcagcaccgcctgaatcaggccctgctgatgggcccgcatagcggccagaagagaatgctcattctccgccatgactacggccatccgcttctttccaattcccgcacatatggttgcaaaataatccaatgaacgcagctgcatagtccctaccgttcctttcacctggtattcatcagggcagagtgcaagtgacgtgccaaatctctgcgccgttggaagccttgatttattgtgctccctccccaatttctcccgccggcgccttgcagatatgcatgattttgcaaagtcgcaagattcccctgcgcacttgaaaaatcaaatggaacttgctatcatgaaacagaaccgtcatgcgcgacaattcggaggtaatatcatgctgcacagatcaatcatgctccatgcggaagacaggattcacgtattgatcaccaggctgcgtgaatccgccgctccccccgagcggcaggctttgttggatgagctgaccgaaattgaagcctctgtccacgaggtagcccacagcgtggtggattatcagcacgttatggacgagctggacgataatattctggtagccgacaaggacgaggtggttctctatgtgaatgacgcctatatccgccacacgggtatcgcccctgagcagatccttggcaagcggatcaccgaactgttggagaccggcacttattttaccgatcccaccgtccccgaggtaatccggagcaggaaaaaggtaatgaagctctccagcatgttcggccggccggatagtctgggattcgtcaccggcgtgcccatctttgacgatgcaggcgagatccagtacgtggtggcctgcaaccggggcgtatccacctttaaggagctgcgggacaactttgtccactttgtggaggcggtcaacaatcttcagggggccgcaggccatgtgcaaatggtgccgaacagcagcggcatcgtcacccctcagatggtaggggaaagccccgctatccagcgggtatatgatctcattgagaatgtacgacagaccaccgccaccgtcctcatcaccggagagtccggcgtgggcaaggaactgattgccgatgccatctaccgcaccagttcccgggcggaaaagccctttatcaaagtcaactgtgcctccattccggccagcctgtttgagtcggaactctttggctatgaacgcggttccttctccggggccaatgcttccggcaagcagggcctctttgaggccgccaacaacggcaccctgcttctggacgagatcggcgagatgcccatggacatgcaggccaagctccttcgggccatccagaacaacgaaatcacccgggtcgggggaatccgccccatcaagctggatatccgttatatcgcctccaccaactgcgatctgaagaaaaaggtgcgggagggcaccttccgcagcgatctgtactaccgcctccatgtgatccccattcaggtaccacccctgcgggagcgggaaggggacgttgcccggctcagccagcattttgtttcggagttcaataagcaatatcacaaaaatgtggtgctctccccggagaacatcgagttattggaaaactactcctggccgggcaatatccgtgagctgcgcaacgtcatggaatatctggtcgtatgctgcgcccccaacggccatgtggacaacagctacatctatggcaccttcgatctgagcaaccagaatgcctatgtggaatatgaccccgatcagagcctcaacgacgccattaccgcttatgagaaaaagtatctggagaatgctctgcggtacgcccgcaatctaaaggaggccagccagattttgaatatcgacccctccaccgtgtcccgcaaattgcgccagcacggacttactctacagggaaaataaaacgtcctgccgcagtgctccagctctgcggcaggacgtttttcttggcacagccggacaaccgtgcgcgtccatacaacggcactggtatcctcgcagccgatgtggctgcgaggggccatttaagagcgggcggccagccgccggtggagaaaggtaaatgcaaaaccggccagggccaccaccgccgcaatgaggaacgcgctgcggtaggagccggttccgctcatcacccaagaggccacctgtgggccgagcatgccggacagcgcaaacccgaagaagaggatgccatagtttaccgtgttgtttctctgtccgaactcatcggccgtaaagccggggaaaatccccatcagggccccaaagcaggcccccaccagggcgatggacaccgcaaataccgccattgagtcctgtccaaagaaaaacagggcgcacagcgcggcaaccgagattgggaataccagggagagcgtgccgatgcgccccagcttgtcggagagaatacccgccgaagcgcggcctccggcattgaacagggaaagcaccgaaaccatcagggccgcagccgcgggggaaaagccggcctccacctgagccatgtcggaggcagaggagattaccatcatgccgctgagtccgccgcacaggagcatggcgcacataccataaaattttttctgacaaagcatctcccgccagctcatgtcccggccgcctccagggagcatttgtcccgcctcctccggcccctgctccacaaatgcagacgccagcagcagcaccactgcaaagcagacggcaataatttggaatgcggcactgaccccccagttccgaatcatgacgttggccactggcggcaccagcacggagctcaggccgtatacgccggtggtcagccctccggccagcccccgcttgtcagggaacagcttgacagaattattcaccgtacagccgtacaccgtccccacgccaacccccaccagcagtccaaagcccacgaccaggccgcccagagtggttgccctgctgcacaacagcagccccgccacaaacagcacgcttcccatctggatcagccggcgcacctcaatgcggcggttaagccagcctccggcggtcatgcagaagggaccggggatgttatacaccgtaaagacgatgcccaggtcgctggcgctgtaggcagctccgccgagagcggtaagccgctcggccagcggcccggcaaatacgctccacgaataagctgatccaatgcacagattgatcaggcagctcatcagcagggtcagcccacgacttcgtttcaagttcattgtatcctccatgtaataacaaaacgcccatatttcccgccccgtcaggtgggaaatacgggcgcctgttgattggccgcctcaccgctccatgattctgcgcagagccggagccgccgcttccgcaatggcccggttgccctcctcattcatgtgcaggccgtccaaaaagtagtcgctcagaggccgtccctcccgggcggccacccggatcagcttctggtggagatccagcagcgggtagccaaataccccgcacatccggcggatccagtcctggtaaaccgcagcctgctcaccgacctgctccagatcggccagaccgttccacttcacccgaatgggcgggcagggcaggggcggtgttccgaacacaggaatggcgccccgtcctgccgtaatatggcccatggcccccagattgcttcgggcggcggcgtcactgccgctgagcaggatatcattgaatccccccatcagcagtaccattcccggtttcacccgatccatctggtattccagtctggccagcattccgccagtcgtattgccgctgacggcacagttcaccagctccatcccgagcatctgtccgcacagggccgtccaccgccgggcagcggataccccgtagccgaaggtgaagctgtcgcccatacataagattttcatcgcctacagggaattgatggccttaccgttccaagcggccataaacgcctctcccagagcctcgttgacggtgggatggggatggattgaacctatgagctcctcgacggtggcctcggcggtcatggcaacggagacctccccgatcatatcggtaacgtgctggccatacagatgaacccccagaatctctccggtatcgccggccactatgaccttaaacaggccgtcggtgtccccttccaccaggcttttcccgttcgccatcatgctgaagcgtccaattttcaggttgtcgccatagttctcccgggcctggggctccgtgagaccgatgcaggcaatctctggttccagatagatacaggatgggatgcggtcataatgcatctcctcatggcggccgcagatatttgccactgccaccatgccctcgtgagaggctgtgtgggccagcatggccttgccgttgacatcgccgatggcgtagatattgggcacgttggtacacaggcagaggtcggtcttgatggcattccggtcaaattccaagccaatgccttgtgcgttcagtccctcggtattgggggtgcggcccaccgccataagcaccgcgccggcctcgagctgttcctgggcaccgttgtactcatagtacacccggttgttttccactctgctgaccttggcccccaggcggaaggttacccctcccttctccagacgtttctgcgccagggcggagacctccggatccaccatgggcaggatatgatccatcagctccagcacggtgaccttgctgcccaaccgactcagcaggaaggcaaactccactccgataacccctccgccgatgacggcaacggagtcgggtacttcatccagctccagcgcctccgtgctggtgagcagtcggttctccccctccacggcgataaaggggggcatgaatacgctggagccggtggcgacgatgatatactcagcggacacctgtttatctcccactgtcagagtatgcgtgtccgcaaagctggccgttccctccagaatgtccaccttgtttccgcggagcaggcctctgacgccgcccaccagggtagaaaccaccttctgcctgcgcttctgcagctttgccatatccaccttcagtgcggagagatccacgccttccacggcgaagtcggcggcatgctttacggtatccagcacattggccgttttgatcagagtcttggtggggatgcagcccacgttcaggcaggtacctccaagataggtggactcgataatgcaggtctttttccccatctgcgccgctttgatggcagtctcataccctcccgggccggcgccgataactgcgatgtcatattgatagtccatagtttgatccttctctcatcccggtatcggtgtacgggcccggcacgctcagtagagctccctatagattttccgtacccgctcctcgtccagggggacgaaattgtttgccatcaggcggccctggctggtgatcacgctgtgggcaaactcatcgatgtcctcccgggtcatgccgtacgcgtgcagaggcttcttgggcaggatctgattcagcagttcttccagcttgtcgtagaccacgggcaccccgcagcccagcaaatcagccagatagcggttcagcaccgcaatctccccatcctgcctgagttccatgtagtttttcagcaccccggtaaacatcgcatagttgctctcgccatgtggcacgtgatatttgccgcccaacggataactggtggcgtgaaccgcggcgcagccggcggttccgaaggccagtccggcatagttggaggcaagcagaaagtcctccagcaggccgattcggctctcctgcccatccatggcaatccgctgatagccccggatgagcatctcaatggctttgtacccgaacagcttggtgtaaggggtggctttgggggacagggaagactccacggcatgcaccagggcatcaatggagctggtggcaaacactccaaagggcaggccctccagcaattcgggaatgagcaccgcctgatcggcatacatggcaggactcaccagtcccagcttggttcccatgcgggtacgggccataatcgaaatgttggtcacctcgctgcccgtaccgcaggtagtcggcacaataaccagctcgcgcttcttttccaggtcaggggccttgtcatacagggcatccactccctcactgccggcgaccgccaacaccttggcgatatcaatcacggttccgccgccgatggccacaatccgcttgcagtcggttttggccgcggcggccaaaatggcgtccaccatcacgtcgctaggctccccggcaccgtactgttcttgaaagaggatctggcagcccagtcccatctgcccaaaatagggctggtaaatgtactgattggtcaggatcagatcctgggagctgagtttgaagtcctccacgaattcccggcaggttgcaaactgatgcagcgtcggtttgaataaaatggagaccatatccgcttcccctccgtcagccgatcgcggtgaggccgccgtcgggatagaggatctgtcccgtgacaaaggcgccggcctcggaggccaggaacaccgcagggcccatgcagtcttccaccttgccgattctctccagaggcttaccgttacccagattcagggtttccgggtgctccttgatgacctccgccatcatgggcgtaaccgtgagggtggggccgatggcgttgacggtgacctcggggcccagctcggcggccagggtgcgggtcagcatatccacggcgcccttggaggtacagtagcccatgttgccgccgccgccgctgaaggcccggacgccccggacggaggagaggttgatgatgcggccgtagccgttttccttcatgaccttaccgaagtgcttacaggccatggcgacgccgattacgttgacgttcatcatatcggccattacatccatggggaagtcgaacaggctgaacttcttgttatagccctgggcgttgaccagaatatccgccttcttgtgattgcttaccacggtgttgaccagggcaatgatgctgtcctcattggtggcatccaccgtgtagatggccacatccttccccactttttccttgatctcacttttcgcccgcacaagggattccatcttgcggctggcaatcacgacttcagcgccgtagaacgccatcgcctcagcaattccctggccgataccgccggcaccgccaatcacgactgctaccttaccatccaaacgaaacaggtctttcataattaataacctcctaacattgttgtggcgagcgttttaaatatggagccgccgcaaaggcggctgacgcttattgggattttctgatcaccgacggagtttctccacccgccccatggcggcaggacttacatcagaatctgtaccgggttttccagaagctgcttcatgtactccacaaactgggaggccagaaggccgtcgatgagccggtgatccacagagagctgaatattcatcatgggccggatggcgatggtatcctccccgttttcgtcggtaatcaccaccggcgttttgcgcaccgagctgacagagaggatggcggcttccggcgcgttaataatggccgtaaagtttccgatgccgaacatgcccagattggagatggagaaggtgccgttgctgtactcctcaggcttcaggcgcccctccttggcccgcgccaccagatccttggattcggcggccacatcggtgaggctcttattctgtacattctttaccacaggtaccacaaggccgttgtctccggccacggcggtacctatattgatggacttgtaggtgacgatctgatcctctttcagcgtcacgttgattccggggaacttcttcagcgccttgcaggccgccatgatcagcaaatcggaaacggcgatgcgcacctcgctgttctcattgagctgcttgcggaaggcggtaagattggtggtgtccaccgcgtcggtgaagtagaggtgcggcgcggtaaacttggaatgggccagcttgtcgccgatgatcttgcgcacccccttgtagggaaccacggaggcgatctgcagttcatcggagccggaagaagctgccgctgcggcggcccgctccacgtccttcttcataatcttctctccggcgccggtaccctgtacggtactcagatcgacgccggttttctcggccagcttgcgggccagggggctggctttgatatcccgctcggtaatccccccctggaatccggttccctgaatggaggacacatcggcagcggcgatgccattgtccttcatgtactttttggcccggggggtgagcttcagctctcccatctctgcgggggcggcggccttctcggcaggctcatcatcctcatcgtcatcaaagtcggcctccacctgggcgtccgccaccacggcggtcacatggctggccaggatggcgtcggcgtcctcgccgggctcgcccaccacggccaccggagtaagcaccggcacggtattgccgggttccagggcgatcttcagcagagtaccggcgcagcttgcttccacggtgatcaccgacttgtcggtgtgcacgtcaaagaaggggtcgccgatggcgacaggatcccccacctgcttgtgccactccgcgatagtgccctcatcctgggtgtagcccagcttgggcatgaccactacttttgccattttgcctccccccttcttacagcagcttctctacagccgccaggatggtgttttcattgggcaccacgagtttttccagggcggggctgaaggggatggacacgtcaggcgcacacaggcgctggatgggcgcatccagatcgtagaacacctcatcctgaatcgcggcacagatctcggcggccacgccgaagctggtgtagccctcgtccacaatgagcagacgcccggtcttctttaccgatttaatgattgtctctttgtccagcggaaccaaagtacgcaggtcaacgacctctacgctgacccccttcttcttttccaggtgcttggccaccttgacacactgtcccacctggaaggagttggccaccacggtgacatcgctgccctcatgcaccacaacggatttgccgatgggaagcaggagattttcatccccgtcgtcgggcatatcaaactccacgctgtagtgcttgcggtgctccaccacaatcacgggattattgtcccggatggcggatttcagcaggcccttggcggtataggcatcggacgggatgacgatcttggagccggggaagtgggcgatgaccgcgttcagattctgggagtgctgggcggcggcggcccggccggcgccgatggtggttcggatgaccatcgggacatttttctgtccgccggacatgtagcacaccttggccatctgattgacaatctgatccatagccaccagcataaagtccgagaacataatctccacgatgggcctcatgcccgtaagggccatgccgatgcccatgccaacaatgccggactcgctgatgggggaatccttcatccgcagatcaccgtacttctcatacagtcccttggagcagcgccaagtgccgtcacccacgccgatgtcctcgccgatcatcatcaccatgggatcccgggccatttcctcgtccagggcctcccgcacggcgtcacgataataaatctttctcatcttttcttccctctcagtcgcagaagatatcgtccatcagctcggacgcctcaggataggggctttcagcggcaaacttgcaggccgcctgaacctcctgttccaccttatcctcgatctccttgcgctccttctctgtaaggtagcccttatcccggaacaggatcagaggatccctggctttccaggcctccacctcctccggcggacggtaggtaccgggatcgctgccgttgtggccgtggtggcgataggtcttgcactccacaatcgagggccccttaccctcccgggcgtgcttgacggccttctgcatcgtcttgtagaccgtttctacatcgttgccgtcgatggtatagccggggatgccatagccgattgcccgcttggccaagtcgtgctctttggtgacccggcggctgtccaccgtgatgccgtaaaggttgttctcaatgacgtacaccaccggcagatcccacgcggcagccatattgatggactcatggaaggtgccctcgttggcggcgccgtcaccgaagaagcacagggttacctggtcggtaccgcggtacttggccgaataaccggcgccggtggccattggaatcccgccgcccacaatgccgttggcgcccagaatgcccaaatccatggccatgatgtgcatggaaccgcccttgcccttggaataacccgtttcctttcccaggatctctgccatcatgcggcccatgtcggccccccgggccaccagatggccgtgcccacggtgggtagaggcgatgtagtcccgcgcctcaatggcggcgcaggcgccggcggccacagcctcctcgccgatatacaggtgggccaggccggccatctgtccggtcttataaaactcaaatacctcctgctcgaaccgccggatcttatacatgtccgagtagaatcgcttggcaagctctttgttcacagaattcccttcttcctaagtgtcatgccggaatcatccggctcagccccggccaggcataccggcaatcaccagcatggaggcggggaggttggtctcattgcggatctcttttccatctcccacattgaagtggatggaatcgtattttttaagtacgatggtctcgtcctttgtgcgcaccgtcatctcaccctccaggatgaaatagatcagctccaccccggtctccacgtactccgtcccgccgccgggcaggaagtgggacaggcccagggtatagtccaccgtattgctggtttccttgttgtgcagccggagggcccgcatatcaaaatggccggtaaccggatactcaaaggcgtctgccaatcgaacaactttcatgtgatcttctccttctgttatttcaacggcttcaggcccaggatttctctggcctgagcgggggtagcgggctgctttccgaaggtgcgcaccgcttgaacggcccgttccaccagttggacattggtggcgggcactcccttgctgaggtatacattgtcctcgagccctacccggatatgtccgcccagggccagggccgcatacaggatgggcaggtggctcttccccacgccaaaggccgaccaggtggcgttctccggcagatggcgcaccagatataccagattttccaccgtggcaggcataccgcccagtacgcccaggcaaagctgatagtggcagggggtagacaggtggccctgttttgcaaagtaatcggcgatccccagcataccggcatcgaagatctcaacctccggcttgatgccgcgctctagatacaggtcgcccagcttctcgagaaactgcgggctattcataaataccccgccgggcatccagttgaaggtaccagcgtcataggagcccatctcgatgccctccagctcccggtgatgggccatccgctcttcatccgtggcgggatgctcggcagaagcgccggaggaggtgcagttgataatgacatcacagtcctggtggttgcggataagccggatggtctcccggaatttctccttgtccatggcacccaggccgtcgtcggcccgcatgtgcagatgaaccatggctgcgcccgctttccagcaggcgtaggcatccgcggcaatttcttccggcgtaatggggatgtgcgcattcttggcctttggggtgactgcgccagtgagggcagctgtgataataacctgatccataatttacgctccttattatttgtggttccgaggacgcttcttgtctctggcccgaatcgcttcatatagactgcaaaccgcgcgccaagtagtgcacttacggtttttgtgcaggaaacgcatggaatccggcataataatcccgcttttgcgctcagatcaggccattagcctcgcacttcctccccacacgcattgcacatccgcaattttttgccgatttgcacacttacaggctcttggccaggtagtacgcatcggatatcgcctgtgtcacctgagcgggcctgacgcagtctccgataacgtattgctcatccaccacgttccacagctcttccattacaccggtacacgctctcattcccacggcgcacagcaccgcgtcagcgggcagcaggtgctcctgcccctcccggtcagtgtaaatcagtccctcatccgtcacggctctgccggttcctccggtgacggcggtgacatacttgttcagctcctgtcccagcgccatgccgtggaacatattcacatcggctgccagcgtatcccgcatctctacgatggtgacctgtttccccttcatgcccaggtgaataccggtttcgcaacccactaaaccgcctcccagaatcaccacccgttctcccagagcgtccgggttcgcctcggcctgggccaccgacaccaccttatccgacgcaatccccggaatggcgggaatcaccggctgggcgccggcggcaatgataaggacatccggccgaaccttctctgccagcgccctgtccaccctttgattcagggtaaccttcacgccgctgctttccacccttcggataaggcactgggtaaagcgatacagatcctgcttgaagggtacggcttcggcgaatttcagcgcacccccaagcgcatccgtcttctcgtacagcagcacctcatgtccgcgccgggccgccgtgattgccgcttccatgccggcggggccgccgcccaccaccagaacctttttctttctcaggggcggggccacataatatttttcctccagctcggctccaatcaccggattcaccgaacagcggtttgtaccattgattacactctcccccagacaaacaaagcagcgcaggcagggggtgatgtcctccttctggcccgtgtaggcctttttcgggaggaagggatccgccagcagcgcccgtcccagctccacgatatcggcctgaccggaggcgatgatctcctcacactgctccgggtcgcccagggcacccacgcaggataccggcttggacaccacctgtttgatggccgccgccagatatacgttgcagccgtgatccaggaacgccgatggatgggttcgtacaaagagttcctgccgctcatggctgccacaggagatattgaacagatccaccctgctctccaccatccgggccaactccttgtagtcttccaggtgcagccccccttccgtaaagtcatcaccgttcatgcggatttgtatggggaacccggggcctaccgcctggcgcacccgatccagggccatcaggaggaaccgcgcccggttctccaggctgccgccgaactcatccttccggtggttttccaacggtgagaggaactggttaaagagccagccgtggccggcatgcaccattaccatgccaaaccccgcccgcttggcgacatcggctgcggcgccataggcatccaggatctcatagatcagcttctggggcatctccaggacctcttccccggaaggcaatacatcgtggctggggccataagcggggcggcgctcttttttatgaccgccgatgctggccaggccggcgtacttaccgccgtgggacagctcaatgttggctaccgccccataacgtgtgatggcccgggcagtgttggtcagagagggaagcacatgcgggtcatccagacagatctgccggtcgtgggactggccggtggccgcatggacaatgctctcccccaaggtaaccacaccgcatccgcccttggctttcagctcatagtaggccatattctcggtcgtgagatggccccgggcggtatagctcatgaggccggtgggggcggagaagatgcggtttttgatcagctgccccccgatcttaattggggtaaacagatggggatagggtgtcataaatatcctccttttgtttatcgcggctgcccgcacggctgtcagggaaccaggaaaatcttgatcccctttttgtcccggaactgggcaaagccctccttccagtcggccagcggcagccgggtgctcaccagaggctccagcatcaggctgttaccatccagcagcttcaggaggatctcccaggaggatctcgcctgggcaaagccggcggtgaccttcagctccttgcgcaccaccatatccatgtccatgggtaccggcttgccatagaggcccacctggataaaggccccctgtttgcgcaccaggctgatcccctggctcagggccgggccggcgccggagcattcaatccacacatcggggccgtaggctgtctcccgggccaggagcgccgccagatcatcggcgttgtcgcacacccactccgcccccaggctcttggccagttccagacgttcccggtcggccttggtgccgctcagaatcacccgcgcgccccggagcctagccagctggacgcacagcaaaccgataatgcccggcccggacaccaccgccacatctccggcgtagatctccgactcctccagcaccgcccggatgcagcaggcaatgggctcactgagcgccaggatgtcgctgcccttatactgttcaggtactttcatcgccgagtctgccggaattaccatatattccgccatggcgccatccacattgacaccgatagaggccttctgtgtgcagtgaaccggatcgcccttgcggcaatagtgacacgttccgcaggaataggcaatggacaccgagatcacctgatcccccacctggaaatcagtgaccccgctgcccacctgctccactacgccggtatattcgtggcccagggtaacaggcacactatgactgtactcctcggccagaatgtgcagatccgtaccgcagataccggcagccattaccttcaccagcaggtcgttcgggcccggaatgggcttttccacctcgcacagctgtactgactcggctcctttacccaactttctcaatgctttcatttccagtcttcctttcttatatccaaccatggtactgtatgacatggaatggagcggtcccgctcctgcggtttttgctgctctcttgttaagcaaatcccatgccaagcaaaaaacaaactgatatgtttccttttcctcctgcaatcccggcaattccagtcagtttagcctctcaaaccagcctgaaagttgcgatgcccaacgcttgcatggctgcaaatttttgcgggaatgcaagccgaaaagctccgcgtttcgcactgtccccctcctggagcgcagctgctctctccttgcatttgtgcaaagtcttgcggcgttgcaaacactccggccctctactgctctttatcactgtccatttcgtacaggatcttcattaaatttttcttagaagttggcgggttttccctacctcttctcccctgctctctcaatttggtatgcttcttgcaaatatccatgaccgcaagcacacagcggtcggtattccgaatgtgccgggtttcccacctgccacttattccatcaagtgtccatcaaccggcagcaagcagccgtcaaaaaaggaaaaggagaatgaacatgaatcactggaaaagcgctttgtctctcgccttggttcctgccttcgccctgacattgctcagcggctgtcagcagaccgccgccccacctgcagagtcctcctctaccggtaaagggggccatgtcattgccgccaacacatggggcgtaggcgcctatcctttggacatcatttttgaggctctgactcccctggagacctctgccggagatttgtccatcgacttggccaacaacgagtttaaggtggataaggtcgtcaccgatcttcagaaccaactcacctcgggcgcagatggcgtgctctttttgggcatgagccaaacgatcttcccaaccgtcgcccaactatgtcagaactttgaagttcctttcgtgttccatgccaatatccccgccgatgccgattggcctgccatacaggagaatgcgtattataccggtgctgtgatatcccaggaatatgccgccggtgtagccatgggcgaactgggtttggctgacggcaaccagacggctatcatttccgccgctgcgctgggcgactacgtccatgaccaacgtatcgccggatttaccgatacttttgaggctggaggcggtgaggttgtttacgtggcccactctgctgacccctctgaaggcgtccaaaaggctaatgactttatgaccgcctatcccgatgcagacatgatctactgcactggcggagactatctgtccgccaccatcagcgccatgtcctcccgccctgaagctgactacaagctttatggcagcgacatgagtcccgaaactgcccagagtattctgaacggcgatgtaaccgccctaaacggcggacagtggatcgccggctctctggctgccgccctactgatcaatcgtctggacggacatgccatcctcgatgaaaacggccaagcccctctgtttgacaatatgaacctggtaatgctgaccaaggataacgcccagggcttcatcaatttaatggcggaaggcggtcttctgacggaagccgattttgatacgctgctctatcggaataatccgaatgtggactaccagagcttctacgattttgtgggcaatgttgacgaactgatttccgagcggatcagctgagataaccagcattaacactgtgacttccggacgacatggacgtatcatccggaggccaaatggagggactgtctatgaataataccttaacccgagcccggaacgagagccggatcaagccgctgcccatcatcatcgttatcgcggcccttgcgcttcttgtggtactgaacgtggtggtggacgggaagtttctgaccttccagaacttcacgattatactttccgcagccaccgtcccggcctttgtcgcctggggcttcagctatctgtttgcctgcggcatcaccgacctgtcggcgggcgccatcattgttctggctgccacagcctccgccattgtgggcaatgcgctcggctatgtccccatgttcattgccgctgtactggtcggcgtgctctgcctggccgtcaatatgacgctcttccaggtcacaaagattcctccctggattgcaggccttggcatgaccatggtctacgagaccatcgccggctattactcacaggtacgggtatctcagggcctgcgggtagagggactggccgatgagatgcgggtgctcggccgcagcccagccatctatatcatgcttgtaatcggctttatcatcgcttacgtgacctataacaagacctccatcggtctcaatgcccgggcggtgggcggcaatgcggatgtagctcagatgatgggcatcaatacccggcgcgcgcttatgctgggcggactgatggccggcttcttcttcggctttgcaggcgtcatgaaggagagctacgccggttatgtggtggctcagaccggtttgagcagcctgagcaccgtatttcagccgctggccgccgtcctgctggcccaggcgcttcaaaagcatatcaacattgccatcggtattccgatcagtacatttcttatcgctatgatcttcaacattctcactcttatgggcgttccatcgggaaccttccaggagttcctcctgggtgtgatcgtcgtcgttttcggcatcacagctcagcgcaatgtgaagggggtcgtaaaatgagtgattccaatctgatcctggaggtcaagggcctgaacaagtggtttggggccacctacgccaacaagaacatcgactttcagcttcggccgggcgaagtacgcggtctggccggagaaaatggctccggcaagtccaccctgctcacccagattgccggcattcagcccagcgactccggcgaaatgtttctaaacggaacgccctataagccccgctctccattggatgccacctccagcggcgtagccattgtcgtgcaggagctggggctcgtccccaaccttcccgccggaatcaacgtcttcctcggcaataccaagcgcttttcccgcttcggaattatcaacaacaggaaggtttatgaggctgccaatcaggccctgagccagtggggacttccccccattcccttccagcggctgtcctgcgatatgaacgtggaatcgcgcaaaatggtggaactggcccgcgccctggcctccgatccccagatcctcattttggatgaattgactcagtccctctcccacgacaaccgcaccgttctctatgaactcatccggaagtttaaggagatgggccgttccattattctgatctcccatgatctggaggagatgctgaagatcaccgacagcgtctctatcctaagagacggcgaactgcttgccaccgaacgcagccaggacatccccctggaggatctgaagatccgtatggtgggccggaaaatcgaaggcgactattaccggagcgacaccactccccagttcgaagaccaagtggccctgtcgctgcgggatgtctgcaccgaccatctcaagcacgtatcctttgacctgcacaagggtgagatttttgggctctgtggtctgagcgactccggcatccgtgaggtcggtcaggcggcatacggcctgctcccggtggacagcggcgaggtatccctccccactcacaacgtttccatcggcaacccttaccaggcccttcaaaacagggtggcctatgtgcccaaggatcgcgacggtgaggcgctgatgatgggcgcctccattcaaaacaatttctgtctgccctcggtcgagaccctgaaagggcgctttggtttcctcagcccaaagaagctgtatcaggcatcctccaaggcgcgggagcaattttccgttaaatccaccggcgtggatcagctgatgagagccctcagcggcggcaacaagcagaaggtcaatttgggccgctggctcatcaaggatctggacgttctcattgtggactgccccacccgcggcgtggacatcggcgtcaaggcatacatctaccagtgtctgcgggaggccaaggaaaagggaatggcaatcctgctgatcaccgatgaactttcggaagtccttggcatggccgacaccatcgccgtcatgaaggacggcgaaatctgcaagctcctcccacgcagcgcagagctgtctgaagagaccattattgaggtgatgacatgaaaaagaaattcagcatcaatacgcttattcccattctgtccttcctcatcctgttctgcgtattcctcatcgccacccgcggcaccctggtcactccccagaatatttccaacattgtgagccaggcttttcccgttatcatcggcggtaccggcgtgctctttgtcaccgccatgggcagcacggatctatccgtcggcgccaatgccgccctctctgccactctgggcgccatggctgcctcccaccttggcacctgggccattttccccgtggccatcggcaccggcatgctggtgggcgcgctcaacggcctgtggaactcccggtgcaagatgccctcctttatgatgactttggctatgctcatcggcctgcggggtctgctgaactatttcctggcctccaacctgatttacgcccccaccgtgctcatcgcgttcaacaccttccccgtcaagctggccatcgtggcggtgctggtcgtcatcttctattatgtatttgagtacaccaagattggttactactgcagggctatcggtgagaacgagcgcaccgtgattgccactggcatcaatgtcaaacgcatccgtatgacggcctttatcatctcaggcttcatggctgcgcttttcggcatcatgcagattgtcaacgtaggcggctctaccaactccctctgccagtttatggagatgcgcatccagatggctattttcctgggtggtgtcagcgtgtccggcggcttcagcgcccggatttataagctgctcatcggctcctttaccattgtcatgattgaaaacggtctgacgctctgcggggtggactccactctgtccagtgctatccagggcatcctgctgatgcttgtgctctttgcaaccatctattttgaacgccgttccgttgccagcaagattcaccacgccgtaaacgccgcaaatgcgtaaagctttgaacacaaacaaaaacgaacaggaggaaacaaacaatgaaagacattatggctgattacgtcaagctccccgaactggaagaatacagggagtggttcaaggatcactttgatctgtaccgggaggacggcattcttcaggtcaccatgaagaccaatgaccaccccatgtgctggagcggcgccaatcatcgcgccatgagtcagctcagccgcattatctccctggatcgcaagaacgaaattctgatttggactcacaagggcgacaactggatgatggacaaggatcctcacggctggagcacctacgccaaagagcgctttgaccatcagtacatcgacgacaccaacctgatcaagaacatgatcttcgacatcgacatccccaccatcggcgccattcccggtcccggtttccactgggattccgccctgctgtgcgatatcaccctggcctccgaggacgccaagttcgatgacgaccacctgttcttcggcctggtggccggtgacggcatgtttatgctgatgcagcacttcctgggtacgaagcgcgccaactatctgatgtatacctgccgccagtggactgcccagcaggccctggactggggctgggtcaacgagctggtgcccaagggcaaggttattgaccgcgcctgggagattgccagaatgctgaagactctcccccgtgagacccgcaccatccagtcccagctgtgcaagcggcctctggagcgcctgctggtcaacgatctgaagctccacacggtcagcgagcagtactccaccatgacccgcatcgctgccagagactacggtgagaagcagaccgacgaaaaggacatgtctatggctcatcactatcgctatgccaccaatgagcatgatgagctgctccagtcccccatccggagctgggatgagattcgggaagacatggtggcctggggtgagcgcaccggctatcaggatcccgacaaggtctacggggaataatcgcttcttccggcagcaatggaaacggggagcggctatgccgctccccgtttcctccatactgacacatttaccacatagggagagccttttcgatgcaagagaaactgtttaaccgatattttattcttatctggttcagcatgctgtgtctgatgctaattcagaacctgatgtgttctggcatcccgctttttttcgccagccgtggcttctctacctccttcgccggtctgctcggcttgcccttcgccctatttggtattctggcccgtactaccggaggctatctgatggatcggttcggccgcagagtcatcatgatcctgggccctctgctgatgggcatcgcctccctgctcttcctgctcctcccctttgcccccctgatgctcctcttccgtggacttcatggggcgggtttttccattgggcaggcgggttcgtccactgccactatagatgtaacccctcgggagaaaagcagcctgggggtaggcatcttttgggtttctaccgctctggcgattgctgtggcaggctggctgatcgaaattttaggcagcggcggcacctatgaccgtattttttacttttcctttgccttcggcgtgctgggcgccatactggcctttctgtgccggtatgaggaaggcaggccgcctgttgtccgggaaccccaggaggtcaatccgctccacggcctgcggaagtttttgtatcccgccgcggcgcgccctgccgttattgagttcttcgttatgctgggggtgtcctgctgcaatatttttatcttcacctacgccgtcctccagggctatgccaatcccagcttctttatggtcgtcgcggccctgtccatgaccgtcagcaacctggcctccggccggctgctcagggccttgggccaccgaactctgctgtccatcgccatggtgctcagcggagccctcatcgctctgatcgcactggtaccctgtcaggcgaccttctacctgggcggcatcggcttcggcatggctcagggcttttccttccccattcttaccctcctggcggtaaacaatgtccctcaaagccaccgcggtaccgccaacagtaccatgttgatggcaggcgacttgggggttgggctcggcactctcctgtgggggatctctatccagttctgtggtttccatgtgtccattgccttgtccggtctggccgtgatcctcagcggtgtgcttagcctgctgttctactgtcgttgtaagccctgactgcgtattatctcgtccgtaagtgaaatcaccgctccaagaacaccggcaagggacatgttccggtaagggccgtcttttgttgtatacaagctcgagcatgctgtattcgcactcctcagccttttgttatccccttttttctgcattgcaattttgctctacttacatatcagcgccccccgttgcagataggtctacctgcaacagggggcgctgatcgttccatgccttttcccgctcatttcaaaacaagatgtctggctcttgttttgattgcctgtcttcaactacacgcaagtccacccgccgtcgcagggcagggtgataccagtaatataccgggactcctcgctggccaggaacaccactgcggcatccatgtcgcctacggtgttcagatccgttggcgtgccggcccgctgcatgggagtcattcgcttgataaatgcctgggactcttccatcaaatcagcaccgttagactcagaagggaacatgccagggcagatattgtttaccgtcaccccctgggtggcccactcggcggcggcggccctggttaagttgatcactccgcccttggcggcctgatagcccgccagaggcactcccaagtttcctaccattcccatagcggaggcaatattaatgatacgtccatagccagcctccaccatcaccttgccaaatgccttcattacccggaacagggagcacaaatccagatttaccactttgtcaaaaatctcctgcggcatatcgacggttgggatggaaggtcctccattaccagcattgttcaccaaaatgtccacttttttgtagtggtttaccacagtttctaccgcattctgaaccgaggcctcgtccgagatatcgcacacaaccgggaggcaccgcccccccaggctctcgatttccctggctgtctcagtcagcttatccggtcttctggccagaatagccagatccgcgccctgccgggccagtgcgatggccattcctctgcccagtcctgccgtaccaccggtgaccaccgccacacggccatgcagattaaatattcccatagaacgttctccttccaattaccagttggcatgtcccccgtcgatcaggatgtcctgtccgacggtgtaagtagacgcatcgctggccaggtagagcaccgctccctggagctcctccacctgggccatgcgcataatgggctgggtattctggtagcactccagcatctcctgggacattccagcgtggagcccggggctgtagcaatagcccggagaaaccgaattgacccggatgccatactggatcacctgggaggcaaaatgcttggtgaaatagagcacccccgccttggacacaccgtaagaggagtcgtcttgggtatgtccaaggggagcctgattcactatgtgtcctgtcagggaggccgtgttgatgatgctgcctccatggccctcccgcaccatcaccctggccgccgtggtcgccacaatgtactggctcaccaggttgatattgagcacctgtttccagtgctccagatgatccatgttatgctcggagtcccaggcctccagatcggggacaagcgccccgcccacacccgcattgttgtgaaccacatccacgctgcccagttccttctcgatggcgtcaaacatctctgccaccgccttggcatccaccaaatcgcagccgtaggccgccgcctttcccccatagaggccggcaaattcctccgcgacctgcttggagcgctccaggcactggggcaaatccacgatggctacattggcgcccgcctgagcaaacgccaaggccgtgtgatagccgatgttgcccgccgcacccgtaattacagctgtcttaccgtccagtcgaaagcgatccagtacatttttcttaaattccatgttgtttctccccttttcttaatcaatcagctcgtcggcgcccacgttgccgaacaccgcttcccaagagcgccgcacatcctgattcaaatttataaacaggcgggcattaaagcaattctcaaaatcctccggatccagcgcaacggaagtagcgcccgtgctcatgagatagctcagttcgtccggagttctgggggcacaggccatgatacgggccgggctgccggaaacctggataaacttgttcagggcggcaaacaccgccttggcatccactccgccatacaggccgtggtcgtcagctccgcccatgagcatgaagcagtaaaacacggagatgtatttcacaccggactgcaatgcacacataccctggagggtagacatgacctgtgtagcacagatatccacatccgcagagagcttctgcatcgcccggatgccgcccgtagtggatgggatcttaatgattgtgggttcccctgcgatcttcagaatcgcttccgcatcccgcatgatcccgtcatagtcattggagggggtttggatgaagagcttgcggctaccggtagccgcccgtagctcctttacaatgttggcaaagtccgtccgtcccagccgtgccaccatctggggattgcagcacacaccggcaaaggggtaaacgtcaataagcttttccacaacggctggcttttcggtattcaggtaaatatcaaacttggacatgttcgtcctcctccttgaagcagtgacaatatatcctggctcagtcccgggtctgttccgggtaaaaatattgcagatagccatcaggcagtttggtcattgcggaatccgtgcgcagttccatgaagaagcccagtttatccttggtattcatataacaccagcttaccggccccacctttccctggcaggacagttccactcctgccctctcatagtcctgaagggtgctctcccactgcttttctggaatctcccggaggatgtggtgatagccaattccgtgctccttcagaaaatcaaagtaaaccaagggcccctttaccggctggatagcttcccactcaatgttgccgcacaccagaatggctaccaggaaggagaagtccacattctgcagccttccatctacccgaaaaccgggatccactacagttttgttattttggcaccccacctcccaggggccgatctccagcaaatcagtaatggtttcgatggttttacgtacatccggagtggtaatattgatctgcgcaatccgcatgggcaccacataattcgggtcaggcgtctcactctccccggtaatgatttcaaagagaatgcccagggtatcagtgaggtccacccaggctgccttgcagacgggcgattccatccgttgagcaatgttgattcccttggactcaagcttggctaaagtggtatcccacatctggcctggaattcgctcccgcacacaacagataccctcgccaaaccggtccagataccgctggtagatggtgtctccctccaccggctgcaccacctgtaaggaggtattctggtaatatattgtggtgcacatctgtgtataggtaatttcctgttttcccactgtcaatccaggatggttctgttccgtctcggtgcgtaccttcccaggggcaacgggaaataccaagcttagattggccagctcttggaatatgtctcggctcaccacagtgatctggtcgaagtttcttcccttagctctctcttgaagctctttaaaattcaatgttttaacctccttatcatttctattgttttctggttccttttgctctttcatattgcaattcacatgccaaataatttagtactgctttggtacccgcaaacgttcagaaacacatgtctaatcccgcttctctactactctagaagacatagccggccagtaccgtccttgcataactgcaaatttttgcgtaactgcatgttcctacagacaataaattattttaaagatttgttgcgttctattctagactctagatctggcacaataaattccagtcttttgtattgccgatacaaaagattgggaaacccttgatttacactagttaggtatacgaagcactcttttttctctatttcagatatcatgcactcttcaatagaaaaatgtattgttaatgtatgttgttctatgcacgacgactttttcccagcagctagttgaacatctactttttatttgaacataacaaaacctccataacattgggtaaatgccaatattatggaggttttataaaaaaataagctacatttcagccctgcagtacaagaccaaaatgtagcttttaacttggcatatgcatacgaaaaagattcagcatttcgctgaagcagccttctggccggcggcgcttttgcgccgtacaagtgttttggccgaaagccaaaaccttggcgcaggcggaattcacttctgccgagtatgtgaagtcctcacggtatccataaaaaaataaccacaccaaaaggtgtggttatttttttggtgacccgtcggggattcgaaccccggacccactgcttaaaaggcagttgctctgccgactgagctaacgagtcatttggctgggatggctgggctcgaaccagcgaatgcgggagtcaaagtcccgtgccttaccacttggctacaccccaatctggctggttctaaaagcaaaggaccggagcggacgctccggcccttccgccttaagggcttatggggtgggtgacgggactcgaacccgcgacactcggaaccacaatccgatgctctaccaactgaactacacccaccatatcgaatggctttagaaaacgatggcacgcctgaagggactcgaacccctgacccactgcttagaaggcagttgctctatccacctgagctacaggcgcttatggagcgggtgatgggaatcgaacccacgcgaccagcttggaaggctgggattctaccattgaactacacccgcatgggcgctgatctctttggcatgtcagccagaaaataatagcatatctccgcattcttgtcaatgcttttttcgaaagatctcgcactttttccaccgccatcggcctactcccgtcgcagccggggatacatggccccgctgccgcagacacggaaaaaatgccgcctttgggcggcatttttctagtcgttggagagcaaaatgcggtcgttgtccaggttcttccccgcgccggcacggaagcgctccagcagatcgtccacggtgaggcccttacgctcctctccgccgatgtccagcaccacccgtccggcatccatcatgaaggttcggctgcccagctccagggcgtttttcatgttgtgggtgatcatgaggcaggtaatgcgctccccctccacgatttcccgggtgaggcggagcaccttctccgccgtggcagggtccagtgcggcggtgtgctcgtccagcaggagcagcttggggggcaccatggtggccatgagcaatgtcagggcctgccgctgaccgccggagaggaggcccaccggctggcgcatccggtcctccaggcccatgtccagccgggcgagctgctcccggaagaacgccttgtcggccttggagacccggctgaagaaggcacgctggtgcttggcggtgcggagataggccagggccaggttctcctcgatggtcatgtggggggcggtgccccgcatggggtcctggaacagacggccgatctggcggctgcggcggtaggcgggcagataggtgatgtccgccccgtccaggcggatggagccctcgtccacaaagaagtcccccgccacggcgttgaagaaggtggacttgcccgcgccgttggagcccacgatggtcacgaagtctccctcggccagcgtcacggacaagccgtccagggccttcttctcgttgacggtgccggggttgaaggtcttggagaccttgttcagttccagcatttacttctccccctttcgcccggccagggcgcggcgctttctggtctggaaagcccaccactgccggatggagggggccgcgatggccagggccaccaccaaggcggtcaccagcttgaggcagtccactggcaccaccttggtgtaaagcaccagagcgtaaacgagacggtagaggatgctgcccgccactaccgcaatggctccccggaacatggcgccccggcccacgatggtctcaccgataatcaggcaggccaggccgatgaccacgattccggtgccgctgttgatgtcagctgtcttctgggcctggcccactactgcgccggacaggccggtgagggcgttggccacgcacaggccgatggtgatggtgaaattggggttgatggaggaggagcgcaccatgtcccggttgtcgccggtggcgcggatgctgaggcccagccgggtgcccaggaaggccaccagcagcacacccgccagcacggtgatccccccggagaggaggatggggttccagtcgccgccgatgccggtggcgcggaagagggtgaagatggtatcctgcttgagcagggactggttggccttccagcccatggccatgaggtttacggtatacagccccgtgttggtgacgatgcccgccaggatggagggcactcccagcttggtctggaggaaggcggtgacaaacccggcgcaggccccggccagcatggcggcggggatggccaggaaggggtgtcccgcggcggtgagggtcaccgacacggcgcagcccaggacgaaacagccgtcggtggtcaggtcggcgatgtccagcacccggtagcttaggaacagggccatggccaccagagcgtactggaagcccagctccagggcggtttgggcgacgtagagcacggaaaaacgctcctttcacaggccagcgcccccggcgggagccggggggctggctttggtttgatctcagtcctcagtggtggtgacggtggtgacctgtcccaggctttcaaagacggcggggtcgatggccagggcggcggcggtctcggagttgacggtgatcaggccgcccgccacctggtaatagtcctccaggccgtccatgcctccggtcatggcctggtaggccagatcggccgtttcggcacccaggtcggtgtagttgacgccgcaggtggcaaaggcgccgttgcgcacgaaggagtcggccccggtgtagtgggggatgccggcggcgatgaagtcctcatagatggccagctcggcggccatgatgatgttgtcggtgggggtgaagacggcgtccactccgtcggcgatcagggagctggcggcggcgatgacttcgtcgttggtgttggcagtggcctcggtataggccacgcccttggcgtccagataggccttggcatccgcgatgggcacctcggaattgggctcggacagggagtagagcaggcccacagacccaatgtctggattctgggtaaacatcatgtccagaatctgattggtgtccagggcgtcgctggtgccggtgacgtagtccatgccggtgagctccacggtctccggataggagatggcggcgaagatcaccggggtcttgctctcctcagcggagacggcggccacctgggcggcggtggtggcgatggggataatggcgtccacaccgtcggcaatagcctggtcggacaattggcgcaggacagtctgatcgccctggccggaggtcacctcatactcgatcgtgatgccgtttttctccgcgatggcgtccagccgggcggtaatcgcgttggcgatctcgtccagggaggcgtgatccatctgcttgatcacggccaccttataggtttcaccggtggcgggagcggcagtgccggactccaccggctccccctgcgcaccgcaggcagagagggacagggccagcgcggccgcggcggagagagacaggattcgattcagctttttcatgtttggttcctcccaatcaaaaattggggcggcagatggtgcaggatgtaaaaaaacgcttctgccccattgctgggacaaaagcgtttcaacacttctgcgataccacccaaattgacgtcaatgacgtccactcgcttcacgcaccatcatgcgtgcccgatggataacgggtggggtcccgtcggcatctactaggttgcccgttcaagccgccctcggaaggccattcgccggtctcctctgatcccgattccaccttccgggactctctttgcatcggaaacgccgggtacttctcttcctcactggtttaccatgtgtggttgttgtaccgtattatacgcacctgttccggctttgtcaactcttttttttgcgcaggaaggagaatttggtctcggagcacaccacggcgatgaagatcagcgcaaagcccacgaacatgaggggggtgggccgctcattggcgaagaggatggagaagaacacgccgaagggggcctccagggagaggagcacggcggcggtggagggggcggtgtacttctggccgatgttctggaacaggagggcgccgcaggaggcgcagatgaccaggtacgccaggcccatgatcaggctgctgtcaaatacgccgggcgtcagcgccgggcgggtgatcagtacccccagccaggaaaagagggcgaaggaggcaaactggagggtggtgaggatgaagatgtcccgtccctcggagtacctggacacggccacgatgtgggcggcgaagaagaagccgccgatgagggtgagcacatcgcccatgttgaaggcggaggcgttgtccccggtgatggacaccagggcgatccccccgatgcacaggaaggcggcaatcaggttgaaccggtcggggcggcgcttggcgatgaaccagtacaggaaggggacgatgacgcagtagacggcggtaaagaaggcgttcttgccggaggtggtctgctccaggccgaaggtctggaaggtgtaggccagaaacaggcagaagcccatcaccgtgccgccgatcaggtactgcttatccagcaccttccaccgccggatgaacaccaccgccagcaccagggccgcaaaagaaaagcggatggccagcagccagaaggtgggcagcacgtccacgctggacttcatcaccacgaaggagctgccccagatgatggtggccaggatcagcagcgggctggcgaagcgggccgggacgctgctctctttgtgttcagtcatggttgtacctctcctttgactatgataaaatcaggtttacacacattcaccgggaaacgagggtttgagcatgtacttattcgactttgacggcacgctggtggactccaacggcgtatgggtggagattgacaacggctttctggcccgccgggggctcacccccacccgcgaatacagcgacaccgtgggccactccatcttccccatcgccgcccagttcaccaaggactactactgcctggacatgacgccggaggccatcatggccgagtggctggacatggcccgggacgcctacgcccgccaggtgcccatgaagccgggtgcggaggcgttcctggcccggtgcgccgcggccggggagcccatggcccttctcaccgcctgcgtacccgagctgtgccgggccgccctggcccgccacaggctgaaggggtactttcgacagatcatctttgtgcaggagctgggcctggagaagcgcaacccggaggccttcacccgctccctggccctgctgggggccgaggccggggactgcaccctcttcgaggactcccccggcgcctgccgggcggcccaggccgtgggcatccgggccgtgggggtgtttgaccccttctacgcctcctacgaggcggaaatgcgggggttctgcgaccggtatatcaccagcttcaccgagctgctgtagggggcgggcggccgcaagggccgcccttataggtctggggctgcggctcagaccttcttcatgtactgggaggcggacttgagcatcagcttcttggtgcccacgctgtcgaaggcgatctccaccagggcgtcgccccccatgggggtgactttggtgatgaggccccggccgaaggccttgtgctggacgctgtcccccatcttgaagccgggcagggccccaccggcgggggcccgccccgccgcggggctcttccagtcgggggcgggcgcgccggcagaggccggggcggcggcggagcccatggagaagccccggtcgaagttgcggcgcaacggcgggcggcgggcagggcgctcggcctcccgctcgacccgctcggcgtagggcaggcggcccgacttctccacatattccggcgggatctcccccaaaaagcgggagggccggttggagttggtgcggccgaagagcatgcgctgggaggcgcaggtcatatagagcttctccttggcccgggtcatggccacgtagcacaggcggcgctcctcctccatctcctcggcctcgccgatggcgcggatgccggggaagatgccctcctccacgcccaccacaaagaccaccgggaactccaggcccttggccgagtgcatggtcatcatcaccacgcagtcctcgctgggatcgtggctgtccaggtcggtatagagggcgatctcgtccaggaagcccgccagggagggctcatccaccgcattctccaggtagttctggatggaggagagcacctcgtggacgttctccagccgggtgcggtcctccacggtgttcttctgctccagcatgacggcgtagccggtgcgctgcaccagctcctcgtaaaagtcgggcagctccatctcgccggagagcttccgcagctccgccatcagctcggcgaactgggacaggcggggggcggccttctgaagctccggccagtccctggcgtggctcaccacgtcccacagggagcggccctccgcctgggcgatggcctgggcccgctccacggtggtggccccgatgccccggggagggttgttgatgatgcgggacaggcgcagatcgtcgttggggttgttgacggcgcagaggtaggccatcatgtccttgacctccgcccggtcgaagaagcggatgcccccgatgatgcggtaggggatgccgttgcgcttgaaggcctgctcaagctggttggactgggcgttcatgcggtagagcaccgcgtgatcccgccagccccggcccgcggagaagccggccaggatctgggcggccacgaactgggcctcgtcgtgctcgttcatggcggtgtagcagtgaaccttgtcccccgcctcgtgctccgtccacagctccttgcccttgcggccctcattgttgcggatgaccgcgttggacgcctccaggatgtttttggtggagcggtagttctgctccagccggatcacccgcgcccccttgtactgggactcgaaggagaggatgttctcgatggtggccccccggaagcggtagatggactggtcgtcgtcgcccaccacgcagatgttctcgtacccccccgccagggtggaggccagcagatactggaggttgttggtgtcctggtactcgtcaatgagtacatagcggaattttttctggtaatactcccgaacgtcatcaaaattctggagcaggcggacggtgtccaggatgatgtcgtcgaaatccagggcgttggcctcccggaggcggcgctcatactcggcgtagaccttggcgattttcaccagccggtagtcccccgccttctcgcactcctggaggtagtccttccccagcttcatggcgtccttggcccgggaaatatagcccaggatggagcggggggcgaaggccttctcgtccaggttgaagtccttcacaatgtccttgatcacccgctcggagtcggcggtgtcgtagatggtgaaggaactggtgaagcccagccggtcgatgtcccgccgcaggatgcgcacgcaggcggagtggaaggtggaggcccagatgtcgttggccgacggccccagcatccgctccagccgctccttcagctccccggcggccttgttggtgaaggtgatggcgatgatggaccaggggaccgccgggtctacccggcacagccgctcctgctccgccttttgggcgggatcggggttctggacgtagccctccagaaaggccaggtctgcgggggcggcccaggcgggcgcctcatcgcagtccgacccgcggccatacttcatcaggttggcgatgcggtgaatgagcacggtggtcttgccgctgcccgcccccgccagcagcagcagcggcccatcggtggccagtgcggccctcctctgctccgggttcaggttctggtagtccagggcgatagccgccctccgcgccttgcagaagcgcagttcctcttctctgttcagcatggttttctccttggcaatggcggagccgcccctgggtggacggctcttgtctcaatacctctattgtaacgaaaactgccccccaggtcaaccttccgaaatggaatcttttgcatgtgaaaaccgcattgcccacggccaaaatctttttgactttatagtgcaaaagcgtctccggtatggtataatacctctccaggcagattggaaggaggtatcccatgcaccgctttgtgttccgctccccccggctgggctttctggcggtgggccccgccctggcccggccggccgccgccttttaccgacgcaaccgggcggccttcgccccctttgacccggtgcagccggaggacttcttcaccgaggaggggcaggccgagcgcctggcagaggagctgggctgggcggaggcggggcggagcttccgcttcctgctggtacagccccggcacccgggcaaaatcatcggggcgctgggcttcaacgagatcgtccggggagccttccagtcctgctttgtgtcctacaaaatcgacgccgccctctgggggcggggctacggctccgaggccatccggtacggcaccggctgggccttccgggtgctggggctccaccgggcggaggccaacgtcatgccccgcaacgccgcctccctgcgggcggcggagaaagcgggctaccggccagaggggctggcccggcgctatctcaacatcaacggcgtgtgggaggaccacatccacatggtcaagctcaatgaggaggaatatcatgcataaatccggttccgacggcaagtttaccagctccatcggctttgtactggccgcggtgggctccgcggtgggcatggccaacatctggctctttccctaccgggtggggcagtacggcggcggcgccttcctgatcccctatttcctgttcgtcgccctgttcagctatgtgggcctgtcgggggagttcgccctgggccgcctcaccggtaccggcgccatgggctcgctggactacgtgctccggcagcggggccgccggggcggccgggtgctgggcgccatccccctgctgggggtgctgggcatcgccatcggctactcggtggtggtgggctgggtgctgcggtacgccgcaggctccctcaccggctccgtcctggccggggacgctcagggcttcttctccgccctggcggtggacttcggctccatcccctggcacttcgcggcggtggcggtgacggccgccatcctgatcttcggcgtggcctccggcattgagaagctcagcaaggtcatgatgcccgccttcttcatcctgttcctcatcatcgccgtccgggtggccttcctgcccggcgccatggagggctacctctacctgctccggcccgactggagctatctgctcaacccggagacctgggtgatggccatgggacaggccttcttctccctgtccatcaacggcgcgggcatgctcatctacggcagctatatgaaaaagggcgagaacatcctccgccacgcgggcatgaccgccgtactggacaccctggccgccctgctggcgggcttcgccatcctgcccgcggtgtttgccttcggcatcgaccccaccagcgggccgcagctcatgttcgtcaccctcccccagatcttccagcagatgcccggcgggcgcatcttcgccctgctcttcttcgtctccgtgttctttgcgggcatcacctccctgatgaacatgctggaggcctgcggcgaggccctcacctccaccttccgcctgtcccgcaccgtttccaccctcctggtgggcgcggccgccttcctccccggcctgttcctggagtccctggcgggcatggggagctggatggatctcatcaccatctacgtctctcccttcggcgcgctgctggtggcggtgtgcatctactttgtgctgggcatgaagggcatccgggccgagctggccctgggccgggcccgggcccccggccgacttttcggcatcaccgcccggttctatgtattcctcaccgtggcggtatggattctgggcatcgcctacggcggcatcggctgaattcccccgcaaaaagcggcctgcgcgcttgcgcaggccgctttttatcgcccttccagccagcccttgaactgctccagcagctccacggccttgaacttcaccacgtagccctcgtcctccccggtcatcagggagacctggttctccgtcagcccggcctccagggcggtctcctgcgtggtctcgctgacggagcccaggcagaggggcgggaacaccacgcaccaccagttctgcccgccccccgcgccgatctcgatgcgcagggcggtgtacgcccctgccgggagggcgaagtcggtataggtcttgggggggaaccagtagtcgtgcaccagggaggcggtcaccggataggaatagcccgcctcccccaccacctccgccccggcggcggccaggtcgtacaggtgggcgcggaggagctcctctgtctccgcccggccggctccgggaacaaacagctcctccgcctcggccagcaccgcgtcccgcacccggagcttgagggcctggtcggcctcggaatccgagttggccagcacgtgcaggcggatcacccggtcggacagggccgcctgggctccgtccagccacacccccagcagggccgccagggccacccccagcagcagcgccagctcccaccggcgcagggtcttggattgcgtcataaaacatcaccgtccactatgtagtgcctacattgtggacggtgatgccggtttctataccattttttccaggctgcgggccaaaaaggtatcccggtagctctcctggagcagctcataggcccggcgggcggcctcctcccggtcgaacaggccgaagacggtggagccggtgccgctcatagaggcccccagggccccctgctgaacgagggcgttcttgatgcgctgcacctccgcgccccgccgctcggggagcacatcctcaaacacgttatacatgcgccgggccactccggccagatcccccgccgccagggcggccagcagaccggcggtgtccgggcggcggcggatgcggcagccgtccagcctggcgaagagctccggcgtgggcaccgagaaggcgggcttgcacagcaccacatggcagtcgggcagggcgggcagagtggtgagcacctccccccgcccctcggccagggcggtgccgccccggacgcagtagggcacgtcggagcccacccgggccccgatggcctccagccgctccggcgggaggcccagccccagcaggcggttgagcccccgcaggacggcagcggcgtcggcgctgccccccgccagcccggcgcacaccgggatggacttgtccagctcaatggacagcccgccgcagtccgcccccgtctccgcgcacaggcgcagggcggcggccgccgccaggttgcgctcgtcggcgggcaggaagcccaggctgctgcgcatggacagaggctttcccgtgccggtctccaggcggagggcgtcgctgagggtcacggtctgcatgaccatgcgcatctcgtggtagccgtcgctccgccggtccagcacgtcgagagagagattcagcttggcgtaggcccttgtttccagaacgggcatcgggtcacccccttatcggatcttgcgcgcctccaggtaaaagcgcttgtcgtgggcctcccccatggagaaggtcttgcgggggagcaccccgtcccggatgacggtgggaaagagctgctccttgcccatggcgggcagcaggaaggcgatattgccggggcgggcggccagatcccgggccacatccgcgccgtggatgtagtcgatgctccccccgtgctccttcacgtaggcgtccaggaagggctggagggtgcccacctccaactgggcctccgggcggggcacagtgaccgcgcccttccccccggcatgggagaagcggagcacatggccgtccccctccccccggtatgcgccggggagggcggagagcagctcctccaccacccgctccggctccacgccgaagaccacccggtggatgggctcgaactccagggaggcgtcgtggaggttgaccagctcgcacagggcgtaccgggcgggcaggctgtcccactgctccctgggggtgagcttcttctgccgctcatagcactccttggcggtggccagggagtggttgccgtcccctacggcgaagaggagcaccggcttgtcctccacgccgtagcgggcgcggaaggccgccggatcggccagcttccggagggcggcggccaccagggccatgctctccccgtccagccgccagccggcgatgtggccgccccgctccatgaggtcgaagtcgtacaccttttccatctggtccttgcgggcggagaggggctcaagcaccgtcttttccgggtcgtcggccagcagcatcacgtggggcagctccaggggggcgttcttgcgcaccgccacccggggcggaatgcgggccatgacggtgccctcggtggcccgcacctgggcctccgcgccgggctcgtagtcgtactgctccagatccaccatgcccaccaggccccggcgcaggcgcaggttgtccagccgccgctccacatagatcaggctggcgggcagggtgcagaaccgctcctcccgcaggtagcgggtcatggtgttgttgacctccatgatgtcggtctccacgcttgggccgtccaggcagctctcgggcaggatcaggcgcagggtggatggggcggagcccaccagctcctccacctcctgccagtactccggctgggaggtgtactggtcgcaggccaccaccgaccacttggtgtaatcacagttctggggcaggaggatgtccgccgggcggaaggccaggccgtcaaacgggtcgcgcatacgtccgccctcctcagtccatggcccgccggatggcggccagcagctcgtcaaagccctcgtaggcgggcacctccgggtggtcggccttgatctgcgccgtgctcttgaagaggaagccggcgcggctggcctggatcatgcccaggtcgttgtagctgtccccggcggcgatggtgtcgtagccgatggactggagggccttcaccgtggtcagcttggactgtgggcagcgcatgcggaagccggtgatggccccgtcgggcgccacctccagggtgttgcagaacagggtgggccagttcagctttttcatcaggggctgggcgaactgctcaaaggtgtcgctgaggatgagcacctgggtgaagctgcgcagctcgtccagaaacgcccgcgcgccgggcagggggtcgatttgggcaatggtagcctgaatctcccgcagccccaggccgtgctcccgcagtatgcccaggcggtactccatcagcttgtggtaatcgggctcgtcccgggtggtgcgcttgagggcggggatgccgctggcctcggcgaaggcaatccagatctcggggaccagcacgccctccatgtccagacaggtgatgtacatatgctgcctcctctcagaatgggggtggatggaagctcagccctcccgggcctgcttcttgcgcaggttggtcaggaagttgtccatgcgggtcagggcctcggcgatgtccttcatgctggtggcgtagcagcagcggatgaagccctcgccgccggggccgaaggcggagccggaaatgacggccaccttctcctccatcaaaaaccgctcgcagaattcgtcggaggtcaggccggtgccccggatgtcgggaaacacgtaaaaggcgcccttgggctcgaagcagggcaggccgatgcggcgcaggccctccaccagatagcggcggcggccgtcgtactcgtcccgcatcttctcgatgtccacgtcgccgttgcgcatggcctcaatggcggcgtactggctggtggtgggggcggacatgatgccgaactggtggagcttgagcatctgctggaggatgggcgcggggccgcagacgtagcccatgcgccagccggtcatggcgtggctcttggagaagccgttgaccacgatggtgcggtcgtacagctccggcaggttggcgggcgacacgtgcttctggccgtaggtcagctcggcgtagatctcgtcggagaggaccatggcgttggtgtccttcagcaccccggccagcgcctccagatcagcccgctccagaataccgccggtgggattggaggggaagggaagcaccacggccttggtgcggggggtgagggcggcgcggagctgcgcggcggtgaggcggaactcgttctccgccttcagctccacgtacaccggcgtacccccggccatggacgtcaggggcccgtagcacacaaaggagggcacggggatgatcacctcatcgccggggttgaggatgcaccgcagggccaggtcgatggcttcgctgccgcccacggtgaccacaatctgatgggcgaagtcgtattgcaggccgaagcggcggttcaggtaggccgcgatctcccggcgcagctccgccatgccggcgttggaggtgtacttggtgaagcccttctccagagagtagatgcccgcgtcccggatgtgccagggggtgacgaaatcgggctcccccacgcccagggagatggcatccttcatctcctccagaatatcgaaaaagcgccggatgccggagggtttgacctcctggatgcgccggcagagtatttcatcgtaattcatgaaaagatccactccttctcctgctgctcctgcttttcaaagatcaggtgcttctccttgtacttgtgcaggataaaatgggtggcggtgcccgtcacgtcctccagggtggacaggcgctcccccacaaactgggccacctctttcagcgtgcggcccgagatgatgacggtgagatcaaaggcgccgctcatcagatagacgctctccacctcgtcgtactggtagatgcgctcggccacccggtcaaagccgtcgccccgctggggcgtcaccttcacctcaatgagggcggtgaccgcctcccggtcggtgcggtcccagtccacgatggcctgatagcccaggatggtcttgtccgcctcatagcgctgaatggcggcctccacgtccgccacagtcatatccgtcatggatgcaagctgttcatgggtcagcgtgcagtcttgttccagaagccggagcagctttgccataatacttcctcccatctgcgtttgagcccgcgcaagccgcgggacagctttataaactcttattatatacgtcccctcccaggattacaatagcgcattcaagctcccccgcgcggcattcgccgctttgtgcggtatgatgaaatattttatttatccctgccattttcttgtagaaatccatttctcaatatggtatgataaacggtgacgtacaaatcccttttcacttcaaacaacgacggaggtgttacgatggactacgccgagatggtcagccagatcatggccgccgagcagggcgccaaagtgctggcggaggagtcccgtgccaggcggcagcagctccaggccggtctggacgaggaaatctccgctatgcgcgagagctatctggcgcgggcccggcagcggctggagcaggtgcagcagactgaggaggccgccgccgaggaggcgctggaccggctggaccgaaagctggagcagaccatgcgcgcggtggaggcgtcctatgagaaaaacaaggagcgctgggtggacaccctgttctccctgatcgtgggcgtacagccgtgaaaaacgcggagatgacctacggcgcgctgtccgccaagatccgcgccctctacggcaagcgcctgcgggcggacgactttgcccggctggccgggctgaaaaatgaggccgaactgctggaggccctgcggcagcatccgggctggagccgcgccctgtccctggtcccccccggcgcctggtcctacgtgggccgggtggagatggagggcgctctgcgggacgagctgcggctggagtaccggagcctgtcctattacgttccccgggaggacaagcccctgatgcagttccagctccgggctgcggagcggagcgccctcctggccgccctgcgccggctcaagaccggccgctacgccaaggagcctccccccacgtctgcggtgcccctccgcctgcggctggacgagggggccctggcctcctgcaccagctacgaccagctcctggacgctgcccgcgacaccatctacgcgcccgtgctccggcacctgcgcccaagccgggacggcgcgctgcccgacttcaccctggcggaggccgccctgcgcaccgcctacttctcccacctctaccgcatcgtccactgtcagtacaccggccgcacccagaaggtacttctccgcgccctgggggagcagatcgacctgctcaacatcatccatgtgctccgcctcaagacctacttcccccagacggagccggagacctatctgcgcgttctcttcccctttcactaccgcctcaaccccgacttcacccgcgccctctgcgccgcccccggcgtggacgacgtcttcgccctgctgcgggactccccctaccgggactgcttcgacggcgtggcggtgggcgcggtggaggagtactaccaacgggccatctgccgcttcaacaagcgtcagctcgccgccgtgcccccctccatttacaccgccgtggcgtacctggagctcaaggagctggagctgagtgtgctgattaacgtgatcgagtcggtgaaatacggcgtcccttaccgcgcagaactcgcagatctggtgggccaataagccccccaagcccatgtcaaggaaggagctaccgcaatgtccgttgtcccgatgaagctgctcaccatcgccgggccgctggagcggtttgacgatgtggtgcgcgcctgcgtcatcgaccaggagttccacccggaaaacgccctgcagctcatgcggagcgtgaagggcctgcggcccctggagctggaaaacccctacagcgcactcctccaccgctcggtggaggtggccgatgaggcgggcatccccctggcctatgcccccttcgaccccgcgtcccccttggaggatttcgcttcctatttcgattccctctccgggcgcatcgccgccctgcaccggcggagggaggagctggagcacaaggccgacgaggcccgcagcatggtggaccagctccagaacctccggggactcaacgtcagcctggacgagctctggggcctggatcacgcccggttccgatacggctacctgccccgggagacctacgacggcttccgggaggccctcaacgaggaggaggacatctttttcgtccccaccaccctgggcgcccggcgggtatatggggtctacttcaccaccaaggaggcccaccacaaggtggactccctgttcaattccctgcactttgtacgcattcgtctggaggacccgcccggcgggacggtggacaacgccacggcagagctcaacgcccaggtggaggccgcccaggcggcggtggcccaggtggggcaggagctggaggagctgcgccggcaggagcgggagcacattctatccagctactcctacctgcgctaccacagcgagtgctgcgggctgcgccagtacgcctgtcgcagcaagggcaccttttacctcaccggctgggtgccggcggcggcggtgccggagattgagaaaacgctcgcccggtttcctaacctgtcctgcgtagccgataccgccgatgacgtgcgccacgccaagccccccaccaagctgaaaacctgcttcctgggccgggtgttccagcccttcctggagatgtatggcctgcccgcctacaacgagaaggacccctccctgttcatggccctgacctactgcctgttcttcggcatcatgttcggcgatctggggcaggggctctgtctggccctcattggccttgtactggccaggtggaagggcatgtggctgggcggcatcatcacctgctgcggcctgtccggcgcgctgttcggctgcgtctacgggtcagtgttcggctttgaggacattctccccggttttaaaatcatggaggagactacctttgcgggcctgggcgtggtgagcaatgtcctgctgctgctggtcctgtccatctgtctgggcgtgtttatgctgctgctggtgatggtcatcaacatcctcaacggcatccgccagaaaaactatgaaaaaatcctcttcgggcccaacggcgcggcgggcatcgtgttttacgccggactgctcaccgcggccgtgtccaccctggccttcggcgtgaacctgttcaccccggcctatgtgctgcccgtgctcatcctccccctggtgcttatgctcctgcgggagccgctgtcccatctgctggccaagaacccccactggagggaattttcagtgggcgaggtgctgggcaccggcttcttcgagctgttcgagaccttgctcagctacctgaccaacaccctgtccttcatgcgcgtgggcgcctatgccatcacccacgtgggcctgatgctggtggtccacatgctggccggcctggccggcggggtgggcggcccggcgggcatcctgatcctggtgctgggcaacgccttcgtcatgggcttcgagggccttctggtgggcatccaggtgctccgtctcgagttctacgagctcttcggccgcttctacgacgacggcggcatcccctttgtcccgaaaaaaatcgactatgctgcccgcacaaacgggtaatcctgaggaggtagtcaccatgctgaaattcattgtcctgttctttgccgccttcgcggttttctcccccctgttcctcatcggcatccgcaagtacaccggacgcagggccaagcgggcccttggagccaacatcgcctccttcttcgccttcctggtattggccagcgtggtgggcatcggcggcagcgcctccgccgccggcacgcctgaggccgccgcggcggctggcggtatcgccgagggcctcaagtacgtaggcgctgccctggccgtgggcctgagcggcatcggcggcggcatcgccgtggcctcctccgcgtctgccgccctgggcgccatctccgagaacgacaaggccttcggtaaggccctcatcttcgttggcctggccgagggtgtggcgctgtacggcctgatcgtggcgctgctgctgctcttcgtgtaatccgtccagaggtatcggtgtgctgcgcaggcgcacaagttgaattgctccgaggggcaagagaaagtaccctggggtgtgtcctgctccgcacggattttgatttgatttcgcccgcggggcgggcgaaacgctgagaggcaacttatgaaatacttcgtcatcaccgacagcacggatacccaggtggggctgcgcctggctggcatcgaaggggtcgtggtgcgggaggagcccctggtgcgcgccgccatccagaccgccgccgccgatcccgacatcgccgtgctgctcatcaccgaaaagctggccgccctgtgccaggatctcatcgccccgctgaagctcaccgcccagcggcccctggtggtggagatccccgaccggcacagcgccggccgcgcccccgactccatcacccgctacatccgggaggccattggagtcaagctctgaccagctccgtgaggaggttaactatgcctgatatgaatcaaaagctggaccgcttcaccgccaaaatcctggcggaagccgccgacgagagcaagcgcgccctcgcggaggtcaagcgccgccgggaactccgctttcaggaagcagaggacgcggcgctgaaggaggcctacgaatgcatccacggggaggtggcccgcatccagtcggaggccgggcggggcgtgtcccgccatatgctggagaacaagcgggccctctacctgcgccgcaccgagatggcccaggaggtcttcgccctggtgcgggccaaaatcgccgccttcacccgcactcccgcctatggccagcagctcactgccctgctggccgaggcgctggagcagctctccggcgcggaggaggtgctggtcaccctgcggggcgacgatctgagctttcgggaggccctggccgcctccgcgccccagatccgcctgaccttccgggagggggacttccgcctgggcggcctgatcgccgagtcccccgacctgggcctgcgggtggactcctcctttgacagcgcagccggcgagttgtctggccactttgccgagctcttcggcctgtcgctctccgacgaataagaaaggatggtacttccaatgaatcaaacgcactataccatccacggcatcaacggcccggtcgtcaaggtgaccggcggcaagggcctggccatgatggatatggtcagcgtgggcgaggagggcctgatcggcgaggtggtcagtgtggaccgctcggccaccaccgtccaggtctacgaggacacggccggcctcaagcccggccagccggtggtgagccagggggcccccatggccatcaccctgggccccggcatgctgaccaacatcttcgacggcattgctcgccccctcaaggtcattgaggcggagagcggccccttcatcggccgtgggctgaacatcccctccctggaccaggagaagacgtgggatgtcaccctccatgtaaaggcaggcgacgttctcgcccctggcgcactctatgcctcctgcccggagacccccctcatcgtccaccgctgtctggtgcccaccggggtgtccggccgggtcaccaaggtggcgcccgccggggcctaccgggtcagcgacactctggtggagctcaccgacgaccacgggcagatccaccccctggccctggcccagcggtggcccatccgcaccccccgccccatcgcccagcggctgcccatcgaccggcctctggtcaccgggcagcggatcatcgacacccttttccccatcggaaaggggggcgccgccgccatccccggccccttcggcgcgggcaagaccatgacccagcaccagctggccaagtggtcggacgcggacatcatcgtctacctgggctgcggcgagcgcggcaatgagatgacccaggccctggaggagttctccgagctactggaccccaagagccagcagcccctgatgaaccgcaccatcctcatcgccaacacctccaacatgccggtggccgcccgcgaggcgtcggtctacaccggcatgaccatcgccgagtactaccgggatatgggctaccacgtggccctcatggccgactccacctcccgctgggcggaggccctgcgggagatctccggacggctggaggagatgcccgccgaggagggcttccccgcctacctggcctcccgcctggccgagttctacgagcgggcgggctatgtgaagaccctggaggggaaggaggggagcgtcactgtaatcggcgccgtctccccccagggcggcgacttctccgagccggtcacccagaataccaagcgctatgtgcgcaccttctggggcctggaccgcgccctggcctatgcccgccacttcccctccatcaactggctgacctcctactcggagtacgccgacgatctcaggctctggtacgacgagcacgtggggccggagttcgtcacctgccgccaccagatggcccacctgctccaaaaggagtcggagctgatggagatcgtaaagctcatcggcgcggacatcctgcccgaggatcagaagctcatcatcgagaccgccaagctcttccgggtgggctttctccagcaaaacgcctaccacgccatcgacacctatgtgcccctggacaagcagctgcgcatgatggagctgatgctcaagctctacagcggcgccaaggacatcgtctcccgggccatccccctgtcccagctcaaggagaccggcatcttcgagtctctggccaagatgaagtacgaggtgccaaacgacggccaggagaagtttgcggagtatgacgccgccattgaggacgccctgcggcaggtcaacgaggccaaccgttgaggttggagatagaggtgaaacactgacatgagactggaatacatcggcctttcggagctgtccggctccctcatcgccctggagggggtcaaggacgtggcctacgacgagatggcggaggtcactctggagaacggggagcgccgctatggccgcgtcatcctcattgacggcgaccgggtggttctccaggtatttgagggcacccggggcatctctctggagaacgcctccacccacttcaccggcaagagcatggacatcgccctgtccaaggagatgctgggccgggtgttcgacggcgcgggccgccccatcgacgccctgggcgagatctacccggaggagcggcgcaacatcaacggctccgccatcaaccccgtctcccgcaagtaccctcgaagctgcatctacaccggcatatccgccatcgacggctgcgccaccctcatccgggggcagaagctgcccatcttctccggctccggcatgaagcacaacgagctggccgcccagatcgtgcggcaggccaaggtgcccaaccaggacggggagttcgccattgtcttcgccgccatgggcgtcaagaacgacaccgccgagttcttccgccgctccttcgaggaggccggcgccctgagccgggtggtcatgttcctcaacctggcctccgcccccatcatcgagcgcatcctcaccccccgctgcgcccttacggcggcggagttcctggcctttgagcacggctaccacgtgctggtggtgctcaccgacatgacctcctactgcgaggccctgcgcgagttctcctcctccaagggggagatcccctcccgcaagggcttccccgcctacctctactcggatctggcctccctctacgagcgggcgggcatgatccacggccgcgccggctcggtgacccaggtgccggtgctcaccatgcccaacgacgacatcacccaccccatccccgatctgaccggctacatcaccgaggggcagatcgtgctggaccgggagctggatcagaaaggcatctatccccccatcgccattctcccctccctgtcccgcctgatgaaggatggcgtgggcaagggcttcacccgggaggaccactacgacgtgtccaaccagctctttgcctcctactccaaagttcaggacgcccgcagcctggccagcgtcatcggcgaggacgagctgagcgagctggacaagcagtatctggccttcggcgacgccttcgagcgcaggtttgtccaccagagcctggtggacaaccgcaccattgcggagacgctggacctggggtggaagctgctgaccatgctgcccaggggcgagctggaccgggtggacgccaagaccatcgaggctcactatgtggagggggcgtggaaggagctctttgagcggaagcagtcatagccggaaaggaggtcaaccgccatggccaacctgctgcccaccaagggcaacctgatcgccgccaagcgctcccggatgctggcccggacgggctacgagctgatggaccgcaagcgcaacatcctcatccgggaactcatgggcatgatggacaccgccaaggagttgcagggacagatcgacgccgtctttaccgaggcgtacaccgccctccaggcggccaacatccgcctgggcatctgcgaccgcatcgcggaggcggtggatgtggacgactccctgaccctgcgctaccgctccgttatgggggtggagctgccccgcatccccggccagtcccccccgccccggccggagtacggcatgggggatacctgttccgagctggatgagtgctacctcaagttctacagggtcaaggagctgacccgccggctggcggaggtggagacctctatctaccgcctggccgacgccatcaaaaagacccagaagcgggccaacgctttacagaacattgtcattcccggcctggacggcaccatccgtttcatcaccgacgccctggaggagaaggagcgggaggagtttgcccgtttgaaggtcatcaagcgggtgaccacaaaacagaagtgaggcggaattccgcctcacttttgtttcagtatgtgcgcacacagacctcccggattttggcctggaggctcttcaagtcctcaaagctctccggccgcttgcggggatcccgcagcagggcagaggggtggtacatggccatcatccacaccccggccttttcgatccactggccatgctcacgggtgattttgaagtcctccttgatgagcttcatggcggcgatgcgtcccaggcagacgatgatcttcggtttgagcagggccacctggttgcgcagatagccgatacaggcctcctgctcaatgttcagggggtcccggttctggggcgggcggcacttgaccatgttgccgatgaacaccttctcccgcttcaggtcgatcatggccagcatatcgtccagcagctggcccgcccggcccacaaagggccggccggtgcggtcctcctgctcgccggggccctccccgatgaacatgacctccgcgtccctgtctccctcgccgaacaccacgttggtccgggtctccgccaggccgcacttctgacagtggatgcactcctcatagagggcgtcccaatccttcatagtctctcacctcagtgtgtggttttcgacattgtaccacacccgcgcccccggtgcaaaaaaattttgtgcttgacttttgccttcaaactgcgtatactacgctcaacaaaggcagagagaacgaccgccccccgtgagggccgacagagaatccgggtcaccgactgagagcccggtccggcaggatgggatggcgcaacacgtttgagccggcgtcccgagccctggcctcagggggtaggcgcgcccgtcccacccgcgttaagggttccgagtggcgtccgttgcacacgacggcgcaattttgggtggtaccgcggagtttattccgtcccgaagctggaaaaccggcttcgggatttttttattctttttttgcagaaaggtgtgattggcatggaagttctggcaacgaaattcgacgcggcggtggtgggccggaataaccgggccgtcaccctgcacgggatggtgcacgccctgcgggatctgggcggggtcaccttcctcaccctgcgcacccgggaggggctgatccagtgcgtctgtccccggcgtcctgagggggtgcgtgaggagtgcgccgtctctgtctccggcttactccggcccgaaccccgggcgcccggcggggcggagctggcggaggcccggtgcacggtgctctcctggcccgccgcgcccccgccggtgcccctgtccaaaaagagttccgtcagcctggacacggagctctccctccgcccagtgaccctccgcgccccccgcgcccgggcggtgttccgcatccaggcggccgtctgccgggccttccgggagtttctccagggggagggctttaccgagatccacacccccaagctgggccaggccggggccgagggaggctccagccagttccggctggactatttcggccggaaagctgtgctggcccagtccccccagctctacaagcaggccatggtgggggtgtttgagcgggtgtatgagatcggcccggtgttccgggcggagaagcacgccacccagcggcacctgaacgaatatacctccctggatctggagatgggctttctccactcctttaccgacctgatggcgctggagcagggctttctgcgccgccttgtggccctgctccggcaggaatacgccggagagctggccctgctgggtgcggagctgcccgatgcggagcacatacccgccgtccgctttgacgaggccaagcgcctggcggcggaggcctacggctatgccatccgggagccctacgatctggagccggaggaggagcagcacatcggccggtacgccaaggaggtgtggggcagcgacttcgtgttcgtcacccactaccccggcaggaagcgtcccttctacaccatggacgatccggaagacccccggtacaccctctccttcgatctgctcttccgggggatggagatcaccaccggcggccagcgtatccacaattacggccagcaggtggaaaagataaaggcgcggggcatggagccggaggatttttcgggctacctgctgttccacaagcacggcgcgccgccccacggcggcctgggcatcggcctggagcggctgaccatgcagctctgcggcctggacaacatccgccgggccagcctgtttccccgggaccggaccaggcttgagccataaggagcgggggcgggcgcggttcgccccccagacagcgaagaaaaggaggaacccttcccatgaatattaccgaagcgcggatcgaccatctgtccgatctggcccgcctctccctccccggcggggagaaggaggagatcgcccgggagctggagcgaattctggactacatggcggtgctggacggtctggacaccgccggcgcggagccgctgagccacgttttcccgctgaaaaacgtcctgcgccccgatgaaaccgccccctccgccgaccgggcgtccctgctggccggggccccggccgccgacggggagagctttctcgtccccaaagccgtggagtgaggtggaatatggagctgtatgaactgactgccctggagctggccgggcagctccgggccggagccgtcacccaggccgaggccattgccgccgccgccgggcggattgccgcctgccagccgggcaacaacgcctttatcaccgtggcggattcgcccgcccccgcacccgcactgtccgcctcccccctggccggggtgcccatggcctacaaggacaccctctgcaccaggggaatgcgcaccacctgcgcctccaaaatcctgggggacttcaccccctgctacgacgccaccgccgtggagcgcctgaccgccgccggggcggtgtccatgggcaagctgaacctggacgagttcgccatgggctccacctgtgagacctcctattacggcccggccaaaaacccctgggatctcacccgctcccccggcggctcctccggcggggcggccgccgcggtggcggccggggaggtgtggtacgccatcggctcggacaccggaggctccatccgccagcccgccgcccactgcggcgtcaccgggatgaagcccacctacggctccgtgtcccggtacggcctggtcgcctacgcctcctccctggatcagatcggccccatcgcccgctccgccgccgactgcgcggcggtgctggagctcatccgtgggcgggatccccgggacgccaacagcctggagctccccgccggggggctgctctgcgccctcaccggcgacgtgcggggcaggcgcatcggcctgcccgccgagtgcttcggcggcgcgctggagccggaggtggccgccgccgtccgggccgccgcgggggtgctccgggcgcggggggcggtggtggaggagtgctccctgcccctgctggactacgcggtgcccgcctactacatcctggcctgcgccgaggcctcctccaacctggcccggttcgacggggtgaaatacggctggcgggcggagggctgcggcagtctggaggagctgtaccgcagaacccgcaccgagggcttcggcccggaggtgaagaagcggattctgctgggcaccttcgtcctctccgcggactgctacgactcctattacaaaaaagccctccaggccagggccaggctgaaggccgcctttgacgcggtcttccagaggtacgacctgctcctcaccccggtggcccccaccaccgccccccggctgggggagggcctggccgacccgctgagcctgtacctgagcgatatctacaccgtccccgccaacctggcgggcctgcccgccctgtccatgccctgcggcttcgaccggagcggcctgcccatcggcgcccagctcatcggcccggccctgggggatctggcggtgctggacgccgcccacgcctaccagcaggagaccgactggcaccgccgccatccggacacgcctgcaagcgccaaaggaggtgacgcgctgtgaactgggaaaccgtaatcggcctggagacccatgtggagctggccaccaaaagcaaaatcttctgcgcctgcaccaccgccttcggcggcgcgcccaacacccactgctgcccggtgtgcaccggcatgccgggggcgctgcccgtgctcaacgggaaggtggtggagtacgccgtccgggccgccctggccctgggctgcaccgtcacccggcacagccggttcgaccgtaaaaactacttctaccccgatctgcccaaggcctaccagatctcccagctctacctgcccatcggccgggacggggcggtggaggcggggggccgcaccgtgggcattcacgagctgcacatggaggaggacgcgggcaagctgatccacgacccctggacggagcagaccaaaatcgactacaaccgctgcggcgtgcccctcatcgagattgtcaccaagcctgacttccgcacggcggaggaggtggtcgcctacctggagtggctgcgggagaccctgcaatacctgggcgtctccgactgcaagatgcaggagggctccctccggtgcgacgtgaacctgtcggtgcgcccggcgggctcggacacgctgggcacccgcaccgagctgaaaaacctcagctccttcaaggccatccgccgggccatcggctatgaggcccggcggcagatcgaacggctggaggcgggcggccgggtggtgcaggagacccggcgctgggatgagaacaaggatgcctcctatcccatgcgctccaaggaggacgcccaggactaccgctacttccccgagccggatcttccgcccctggagctgagcgaggcctacatccaggcgctgcgggccagccagccggagctggcggcggccaagcgggcccgctatcaggccgtctggggcctgggctcctacgacgcggagatgctcacctcccagaaggccctggcccgctttttcgaggagacggtggccctgggggcggagcccaagcaggcggccaactggctcatggggccggtgctggcccagctctccgcccacggcctggaggccagggacatggccctgacgccccccaccctggcccggctgatccaactggtgaaggaggggcggctcaaccgcaacaccgccgtcagggtgtgcgaggcggtcttcgagaccaacggcgacgtggacgcgtatgtggccgcccacggtctggcccaggtgtccgacgcaggcctggtggcccaggtggtggagcaggtgctctccgccaatgaaaaatcggtggccgactaccgctccggcaaggagaaggccttcggcttcctggtggggcaggtcatgcgccagctcaggggccaggcggccccggcggtggtacgccgggtgctgctggaacagctggcggagcaataacaacgtgcgggccggtcttttgaccggcccgcacgttgtttgccccttccgccgcggcttcacaaatcactacgaaagcccggtacagccgtccagcacctgtccgccctggagcagctccagcttctccagcgcggggctgccctccagcaggaagtggaaggtctggccgggataggcccaccgggtcaggctctgcccgcctccgtaggtgaggcggacggtgaggctgtccccccgctcgccgcccaccgcgccgaagatcacggtgccgcccccggggcccagccgggcggcggagagtttgcccggctccggcgcggggcactcgttggcggtcagctcatgccagcaaccgtccgtcccgctccgctccagaccgctggcccggagggtggtgtgggcctcatcccaggaaagaaccacatagccaggcccagcgggaaagacggcgtccacgctccggttcggctgctcccgctggaagtccgcctgggggcccgaggacagggggccgaagcccgcgctgcccacgcaggtctggcccgcctcgctcaccatgaactccgccagccgccgggcgggggcgtcctccggctcgccggcccggagcaccaggtagttgtaccccgccagggggtagcttccgtcggcgatggtctcatccgaggggagcaccccatccaccgccagcagcttgagctcccctccgcccgcgtcgcccaggagccaatagctatttacataataatagtacacactatagcccatggcgtaagccagggggtcggtggtcatggccccggccacatcggtgagggcggaggacatggcgtaggaggtgaggacattgtgcacgtcggggctgagggagagctttccgccctccaggaaatactgctccatcagggcgtgggagccgctgtcggtgttgcggcggtagggtagcagctccgcgtccgggccgtctatctgattccaattcgtatatttcccgtacacatatatgtcctgtatttgcttttgggtcagcccggtgacagagttctccgcgttggtgaagaacaccatggcgtcataggcgatgggaatgtactccagttccacccccgccgcctccgcctgggccttcagctcctccgagggcagggtggcggcgaagagggcgtccacctccccgttgatgagccgctcgtaggactcatggctcttggagtggctctccgggaactgcggatggttgtcataattccagaagagcgccccgtatacagcccgggtgtaggggtaggtggaggtggagccgtcgacgatgggcatagtttcgtcaaagccccagtcgatggcggcctgggtggggtaccagggcaggcgggtacgggcgtcgtccaggaaggtgatcgcctcgccccgggtggcgggcctgtcccactctgccagctcctccactccgggctccccgtagaccgggtcggtctctccggtggaccgctgggtgaagatgcccagaccctgcttgtcaaaggccagataggacgctaaagcccagtccggaatctccccggcatcgaccagagtcagctccgccgccgttcccccctccggtatggtcagccagcccgccgcctccatggcccgggcagccatgacggtgagctctccccgggtcaccagccggtcggggtggaaagaggcgtcctccgccgccagtccgccggcccgggcggcggaggcggtatcataataccagtcgccgggctccacgtcggcgtagccggggtcgccgccgggctccagggacagcaggtgaaccagcagggaaaaggcctccgcccgcgtcagggcggcgtcggggttcagattgcccgcgtgatccccctggatcaccccccggagatacagctcctttgcgccgctggggtcgttgtagtactcgtgccccttccagacggtgatgcagtcgggaaagcggtgctcctccccctgaaagacctccaggggccgctccgcctccgccgccgggacggtggcgaagagccagccctgctggtagtcgctggtgaggggcaccggctcccccgtgtcggcgtaccgcaccgcgaggagggtctgctccgaccagtccagggcctccccctgggggcagggcacccggagggtcacataatctccgcccggctcgctccggctccaccccttcgcctcctctgccgcccgggcggcggggcacagcagggccagacagaggcccagcgccagtattcgcttcatggtacacactcccttcaacattcgattcctatttgtattatagctcccctggttttcccggacaagttacagagcaataacaaatggtaaaaaaagctggtacagccggggggttgacagggggcggtctttctgttatcttaatacccgacagatgaatgccctgtggcttcccgtttatcaccggataaatgtgaaacgtgcctgaaccgattccgtaggtcttagaaggaatcggcccaggcacgttttttgccgctctgggacgtttttaggagggatcggagtgaagcggagctttttccagtatgtgagcctgaatgtgctgggcgcgctgggcctgtccggctacatcctggccgacaccctgtttgtggcccaccggctgggcaccgacgggctggcggccctcaacctggccatctcggtcttcggcctcatcaacgggctggggctgatgctgggcattggcggggccacccggtacgccatctgccgcacccagggggacggcgtgcgggccgaccgcgccttctcccgcgccctggcctgcggcgggacgctgggcgggctactggcgctggccggtctgctgtgggccgtgccgctggcccgcctgctgggggcggagggagccatcctgcccatgtgctcggtctatctgcgcacggtgctcctctttgccccctgcttcctactcaaccacattctcaccgccttcgtgcgcaacgacggcaatcccaagctggccatggccgccatgctgctgggcagcctgtccaacattgtgctggactatgtgttcctctaccccatggatatgggcatcttcggcgcggccctggccaccggcatcgccccggtagtgggcctgtgcgtgtcctccctgcacatcctcacccgccgcagccgcttccgcctgcgccccttccgccccgccctccggccgctggcggatctggccgggctgggcagcgccgcctttctcaacgagtgctcctccggcctggtgctggtggtcttcaacctgctgaccctccgcctggcggggacgctgggggtggcggcctacggcattgtggccaacctggcgctgatggccctcgctctcttcaccggcgtcaatcagggcgtccagcccctggtcagcctggcccacggccggggggacgccgccggggtgcgcaccctgtgccgcatggccctggggctggccctgtgcgcggggctgtgcatggccgcgctggccttcttcgccgccgggccgctggtgtccctcttcaaccgggacggagatccggcgctccagcagatggcggagcagggcctgcggctctactttctgggctttccctttgccgggctgaacctggtcaccgcctccttcctgggggcggcggagcaccccagccgctccctccggctctccctgctccggggctttgtggccatcgtggccgccgccctgctgctggccgccctgctgggcctcaccggcgtatggctggccttccccgccgccgaaggggccgttctcctcgtcagtctgcgcctcagccgctccctccggcgcgcccggccagaacccgcccctcaggccatcaccaccgcgctcaggtaacacgcgaatgccccgtactccgccggggtcagcgcccgggggctggagagcaccaccagctcatggcccgggtactccggccggtaggggggatggacgtggggataggggttgacggcgaagccgcacctctggtagaagccctgccgccgccgggcgatatcgtccaccggcgggtcgatctccagtaccacggttttcccgtcccggcccagctcctccagcgccttggcgccgtagcggcggccccgcagctccggacggacgcagaaatgctccacatagcggaagtcctccgcctcccagtagagcagcagccccacgaattccgccccatcaaaaagctggctgaaatggtactccgggtgggacaggacggcccgctgctcatcgggcagccgctgctcgtggcggggaaagctggcctcgtagagggccatcgcccttccaaacgccggttcctccggctgtgtcagccgtctccattccatagcagtcgctcctctcttctaaaaaatgcgctcccgttttgggagcgcattttattttttctgtttacgctccctccagggccttttccaggtcggccaggatatcgttcacatcctcgatgcccacggagaagcgcaccaggtcgggggccaccccggcggcggccagctcggcgtcgctcatctggcggtgggtggtactggcggggtgaagcacgcaggtcttggcgtcggccacatgggtggcaatggaggccagctccaggcccgccatgaacttagaggccgcttcccggccgcccttcacgccgaaggacaccacgccgcaggtgccgttcggcaggtacttccgggcccgctcgtagtaggggtcgccctccaggccggggtagcgcacccagctcaccttggggtgtcccttcaggaaccgggccacggccagggcgttttcacagtgcctggccatgcgcaggggcagggtctccagccccacgttgagcaggtaggcgttcatgggggcggggatggcgccgaagtcccgcatgagctgggcggtggccttggtgatgtaggccccctccaggccgaagcgctcggtgtaggtcacgccgtggtagctctcgtccggggtggtgaggccggggaacttgtcggcgtgggccgtccagtcgaaccggccggagtccacgatggcgccgcccaccgcgttggcatggccgtccatgtacttggtagtggagtgggtgacaatgtcggccccccactcgaaggggcggcagttcaccggggtggcgaaggtgttgtccacgatgaggggcacgccgtgggcgtgggccgccctggcgaacttctcaaagtccagcacggtgagggcggggttggcgatggtctcgccaaagacggcccgggtctcaggccggaaggcggcctccagctcggcctcggtgcagtcggggtcgacgaaggtgaagtcgatgcccatgcgcttcatcgtgacggcgaagaggttataggtaccgccgtagatggaggaggagcacaccacatgttccccgcaggagacaatgttaaagatggcgtaaaaggaagccgcctgaccggaggaggtcagcatggccgcggttcccccctccagggcgcagatcttggccgccacgtggtcattcgtggggttctggaggcgggtgtagaagtagccgctctcctccaggtcgaagagggctcccatctgctcgccggtggcgtagcggaaggtggtggactggacgatggggatgttgcggggctcaccattcccgggggtatacccggcgtggaggcactgggtgccgatgcgctgctgactcatgggcaggatcttcctttcctgtttcaggttgagtgttatgctacacccccgcccggcccttgtcaagaggcgggcggggtgggactgggctccggctcctccggcggcacatcggtgccgtcggtgagcagcagtccgtcgggaccgagctgctggacgcggcggtaagggatctctctcccctccaccgtcacatagaccgactccaccccctccacctggcacagcgtaagggtcaggcaggcgtcggccacggtgagatccaccccggacaggccgccgtactgctcggagagatccaggtggaggcggccctcctccacctcccagctcaacaggcgcaccccctcggggaagggggtggcgaggccctgggtctccggcggggacagcagggcgtccaccagggcagggatggggtcgccggcgctcccctcaaagggctcacagtccagcggcaggggggcaaagcggtcggacagggcggagtagtacacgcagtagccgccctccggctcctccgggcggggggcgcagcccccggcggccagagccagcagacagcccagcgccgcgatgcgtcgtctcatcggcccacctcctctccgttccactgggcaaagctgacctcgaagcaggtgccctccggctcccgccgccgggcagtgacggctccgccgtgctggagcaccgtgtcccgcacgatggacaggcccaggccggtgccgccggcggcccgggagcgggccttgtccacccggtaaaagcggtcgaagatcttgggcagatccgcctccgggatgcccacgccggtatcctccacccggaggaccacccgcccgccgtcggcagtgagggtgacgagcacccggccgccgggcaggttgtacttcaccgcgttctccatcagattgaaggcaatctggtagaggtcgtcctcggtggccagcaccacgcagcccggctggagcttcagctccaggctcacctctaccgcccgggccaggggggagagcatgtgctctacccgttccaccaccgcccccacatccacggggacgtcctccgccgccggggcggtgtcgagccgtgtgagggtaagcagcttctcggtgatgcgggtgagccgatcagcctcgtccccgatgtcgttgaggaactcccgtgccgtctcgccgtccatgtggtcggcctggagcagggagtcggtgagcaggcggatggaggccagtggggttttgagctcatgggaggcatcggagacgaagcgccggcgcacctcctcggtggtctggaggcggccggtgagctcgttgaactcgtcggccaggcggctgagctcgtcgccgccccggacgctcacccggtggctgtactcaccctcccgtaccgtgtggatgccccgcaggagctgggcgatacgccgggtgagggccttggagaacaccacccccatcaccagcgacaccatacagatgacgatggagataaagcgcaggttggtctggatcccctggagcagcgcgccctgctcggcgtcgtactcgtagaggtagaccgccccctgggtcatggagcggtaggtaatgggcaccgccgcccagcttcggaaggccccgtcgccgtactcggagcggaacacgttgttgccccgcagggcggtgaccagctcccagaacagggcgtaccgcccggcggtgtcggtccgccccacgccgtcctggaaatcgcagagcaccaggccgttggggtcggtgaccaccacccgggtcacccccaggctgccccgcagcagctccaccgtccgggtggcgccctcggccgtaagggcctccggcccggtggccagggcggaggccagcaccgaggcctggttgagcatggaggcctgcttggactggtaggccagcttttccgacaccaccagggggtaggtgttgagcagaatcagcaccgccgccacaatcacaatataggtcagggcgaacttggtctggagggagcgccagaagggcacgcgcctgaccgcgccgctccccttatccatgcttcagatagtagcccacgccccacttggtgaggatgtactccgggttggcggggtccagctccagcttctcccgcaggcggcgcacgtgcacgtccaccgtgcggtaatcgccggcgtactcatagccccacaccacgttgagcaggttctcccgggagtacacccggcccgggttgcgcagcaacagctccatcaggtcgaactccttggcggtgagatccacgctcttgccgtccttccaggcggcccgggcgtccacgtccagggtgatgtggcccatggacagccggccgccgccctgcttctgggccgccatgcccgcccggcgcagcagggcccgcacccgggccttcagctccagaatgttgaagggcttggtgatgtagtcgtccgccccacactcgaagccgatgatcttgtcggtgtcctcgctgcgggcggtgagcatgatgatgggcacgttggagaactcccggatgcgcatacaggcctggagcccgtcgatcttgggcatcatcagatccaggatgatgagatcgaaggagccgctgcgggccagctccaccgcctcctccccgtcatagcccgcctccacctggtagccctcgctctccaggttgaacttgatgcccttgaccagcaccttctcgtcgtctaccaccagtattttcatcggttctcctccccagtcgtcacgtagtcaatgaggccctccagaatgccctcgccgatgcccggcacctcggtcagctcctccgggatgcggaaggggccgttggcctggcggtaggcaatgatgtcctccgcccgcttctccccgatgcccggcagggtcatcagctcgtccaccccggcggtgttgaggttgatcttcgccccgccggcaagggtatcctccttgctctgggcggagggggagggcgtaggcgcgggcagcgccaggggcgtctcctgggtcagggtacgctcggtctccacccgcacgggctggggcgcggcctgcccccgaaaaaaccagcccgccgcgaaggccgcaaagaccgccgccagcagcagggccacaaattccagtctggaaatcttcatctttttgtatccccctccccgttgcgtcccggtccggggtttgttataatagccataccgttattataacatagtcaaatggagtttcctatgaaaaaatcacgactgctttccgttttactctgcctcgccctgctctcggggctgctggccacctttgcctccgctgcggacagcggcagcgccattctggacgagatggacgtcaacgccaaggccgccgttctggtggaccccgacaccggcgagattctctacgagaagaacgcccacgcgcacaactaccccgcctccatcaccaaggtgatgacctgcctgctcaccctggaggcggtggaccggggagagctgtccctggagcagaccgtcaccgccagctccgcccttcacaccggcatcggggagggcgcttccacggccgatatcaaagagggggaacagatccgcatcatcgacctgctctacgccgccctgatcccctcggccaacgaggcgtgcaacgtcatggctgaggcggtaagcggcgatgtggcctccttcgtggagctcatgaacacccgggccgccgagctgggcatggaggacacccacttctccaacacccacggctaccacgacgacgaccactacaccagcgcctacgacatctacctcatgtgccgggaggccatgaagcacgagaccttccgcaccatcgtgggctccaagaactacaccatgcccgccaccaacctgcaccccgagccgcgcatcatccgctccaccaacgccctgatctccaacttccgcgtggcgggctacatctacgagtacgcaaccggcatcaagaccggctccacccctgaggcgggctactgcctggccgcctccgccacccgggagaaccggaacctgatctccgtggtcatgggctgtgagcgtgagccgggcacctccggcagcgagggctatatctactttgacgagaccatccgcctgtttaaatggggttttgccaacttctccacccagaccattctggacaacaccaagcgggacatcccggaggtggaggtcaccctgggcaaggacgccgcctccgtcacccttatgcccgacggaaagctgaccgccctgctgcccaacgacgtgtccgccgagaactttacgtatgactacaccctggaaacccggagcgtggaggccccggtggagcaggggcaagtgctgggcaccatcacggcctatttcaacggcagatcctacggcaccctggatctggtggccacctgttcggtggagcgggacccctggctctaccggctggaccggattcagaagttctttgacaatctgctggtgcgcatccttctggtggtcgtcctggtagtaatcgccgccctcctgctgcgggtgatgttcttccgcagcaggggccggacaggccgccggggctacgcctacagcggccggggccgctacaccggcagccgccggcgcagaggctaaggtacaaaaacgtggagggcggtgtataccgccctccacattattatccatcaataacccctcctgcgaaggcgttcggagggaaggatgtagttcaggaccttttgactcctgttttcacaaactgctaaacccctgaccggcagctcccggccaacgtcggccgcagttgctcaatcctgcctccttcctgctggggccgctgatccgtagcccctgcaaatacacgttttcctccagtgtcgtgttgccataggaaatctgggctgtcatcttattacaaaagataaccgtataacggtttacccgttcacgcatagcgtaacggataaaccgttataacaagcgaaggaagatggactgtgaaatttacagtccatcttccttcgccacttacgcttgctttacaacgcaaagaatcgtccctgtttctacagtgtccatattttcaataacagcatagtaattggtcgaactgtttagattagaaaatgttaccgtctcacttcctcctcctcccagcggggtagaccacggcaagttaactgtactcgttgctacactaacaccggaacttttatataatgtcaccttaacatgaggtgatgctccccctatactctgcaatgtaactttaatcttgctctttgatatatcatatgtatctgtagtatatttctccccagcatctagaaccccaaccgtaaacgcaacgcttccacttgaaagatctactgtacttttgcgactttccaccatactttcttcaaatacgttaccatacatttcaaatatgtctttttcttcatgctctacagttacgataacatttgcttctttgccctctacggccatagctgtagaaggcagaatacaacaagcaaataacaaaacgctacatatcatccttgtccatacttttttcatagaaagttccctccatttcattcctcaatgtaaaaaactagctttttacctttactatctctagttccatcaattttgaaatagtattgcttctctcctgatagatttgaaaaaacaagtttatctcctacactttctatttctcccgtttggatactttcttcatactctatatcatataaatctacttttaaatttgaccaagctccttccgcatatttaatctcaattgttccattagctggacatatatagaactcagtcattaatggcatattcccaatttcacttatatcaaaactaatctcacctatattggagggcttaagtgtatcgcctgttaaatctgtagcatctttctcttctgatgagtatgaactgcatccgatacaccccaatagcagataagccgttattaataaaatcggtatgattttccatttaatagtagacatatcccaatacctcgacgctatttttagtattatttcgtaccgcaaaataatactttcctgtatcctcgatctggatattggttttgatactgccctcactcccgctggtaaaatggaacgtattatccggggtgatgaacccgaagtcaaggtctgctgtcctgggggagtacgtgcagtttatcgtaaccacctcgtccgcctccagggagtacgcggtatctgccttcataatcttcccggaagggatatcccactcaatccggctggtggcccgcgtcatgctcccgcccttactttctgaaaggacagcagggtcaactgcttgcgttgaaagctctttaaagccgatcatttctgtcctggtatcagccgccacgatactgcttttatcaatcgaaactgagtaacatacgtctgcgctgctttccgcagctccggccggggtcagccccacaccgcccaccacaagcgcacaagccaataccgtcgctgtaactgattttttcatcgccgcatcattcctccctatgaaattggcccgcttattactgcatcggaatcagagatcctttcctcttccagtccttcaaacttcactgtattttgttcttccggttccgtgtccttctggttcagatatgtaattacgattgctgcaacaagggccgcagcggccaggataattagaatcacttttagtacagagcgtccctttctatttccgctgccttgcgtcttttcactctccgggacgctgacaactttatcgccgcccataagttcatccgttggaactccaaacaatttactcaacgccagcagattatccatacttggaatagcaattccaacttcccatctggataccgcctggcgcgatacattcaaagcctctgccagatcctgctgagacatccttttgtcttttcgtaaagaaattaacctttcatttaatttcactgttttcacctcaaattctatgcaaacaatcgccatatgtaaaccgcaagctgtttacattcaggcaattatgaattgcttttgggttgcgctgcaacttttttaacaaaacaggggcaacaccaccgtcaccagtccgcccatcgggcgctccctccctcacaaaagctgcacccccagcagggggatcagatccaccgcctgggccgggttgatcttcatgccccgcagctctcccaggctctccgatacggtgatgccctccagcgcgcagtcggaaaaatccacccccttcagcggcgtgcggaaaaagtccacctcctggaaccccgtccggtgtgggctcaggccggccacatccgcctcggccagcacggcccggcgaagctggcagttctccatgcggcactttttccaccgcgactgtgcaaaattggcgcagcggaaggcgctctcgcccagggtgcagctccgccaccggctggcggtgaaccggccgccgtctcccttgcagtcccgcaccaccgtgtccgtccagaccgtcccgccgaagcggcagttggagaagtcgcagccgctccactccacccggtcaaagaccgctcccgagaagtcgcagttctggaaccggcaccggtgcaggcgcacccggcggaactccagccccgacaagtctgcgcccgccaggcactccccctccaccgtcacgtcctccacgtcccgctcttcccgccgcgcccggcgcacttcctcctccagcatgggtcagcactcctttctccccctactctactacaacatgccgactttgtatacatacgattgcaaaaacgcccccgccgtcggcggggacgccagtatgtcgaaaaagcctcgcagagttcgcgcccgcaggcgcgaatcaagtaccaatctggtttccccggtgacatgtgcgtcggggaaaacacttctcaggctgcaagtgttgggtctggccgccacaggcggacaaaccctgcgcgcggcagactgcggctttctcgaaaaagtggctttgccactttttcgacagactgcgcccccgccgtcggcgggggcgtacggattccgctacatcaggaacagggagagcaccactgtgatcagcccgcacaccccgatagccagcccgctcatggccccctcggtctctcccagctccagagccttggaggtgcccaccgcgtgggagctggcgccgatggccagcccggcggtcatggggtccttcacccggaacagcttgatgagcagcggggccgcgatgctgccgaagatgcctgtgatcagcaccgccaccacggtgatggggccgatgccgccgtgggcctgggatacgctgatggcaatgggggtggtgacggatttgggcaggagggacgcggtcatggccgcgtccagcccaaacaggcggcagagcagaaggatgctgcccatggaggacgccgagcccaccacgcacccaaccagaatgggcagccagttctccttcagaatacggattttcccgtagatggccaccgccaggcaggcggtggcgggggcgagaaacatgttgatgatctctccgccctgatgataggactcatagggaatgcggaacagcagcagcacccccaccaccaggacgatgccaatgagcaggggattacagaccaccaggccggtctttttctggatgcgcaccccaacccagaaggccaggatactcaaagcgatgccaaaaaagggggaagcaaacagctcagacacgggacttcctcctctccagcaggcgcagggtgaaccggatgctcagggcggtggcgccgaaggtgatcaccgttgagagcaggcagaccaacaccagcgcgacggccgagcggcccagcacatcgaagtagttgatgacgctcaccccggcgggcaggaaaaagaaggccatgttggccagcagaaaatccgccttttcccggatatgctcgattttgagcagcccggtggccaacagcgccagcagcagcagcatgccgatcacgctggccgggaatggaactggcagcgccgcctcaatgagctggctgaaccagcacacggcaaagatgacgccgatttgacagatgattttcacgggaatacgcctcctgttttacacataaagacgattgtagccccgatctctctccctgtcaaccagcttcctccgcctgttgaggctgtcgataaacccttcaggcagagatttcggagggaacgatcgtgtgaaagaaaaccgtcaggggtttctttcgcgtttgatccaccggctttttgaacttttttgaaggttcgaaaagtccctcggcctgtcgaaaatactttttcgacaggctgaacaggcgggggaaaatcccccgcctgttttgatcatttcctttacttctgtttgcgctccaactggagcttgtcggcgatcatggcgatgaactccgagttggtgggcttgcccttggcgttgctcaccgtatagccgaaatacttttgcagggtctccagatcaccccggtcccatgccacctcaatggcgtggcggatggcgcgctccacgcgggaggccgttgtgccgaaacgcttggccacctccgggtagaggatcttggtcaccgcgttgatcacatccatgtcgcccacggcgatgatgatggcctcccgcagatactggtagcccttgatgtgggcgggcacaccgatctcatggataatggaggtgacggtgctctccaggttctggctctcaccagagaggcgcccgggctcctccccgccgctctggggctgtcccgccagttggcggatgcgctccatcacggcggagagtttacacggcttcatcatatagtagtccgcgccatgggccgcggccagctccgccatattgccccgcgcaaagctggagagcaccagcacccggggccggccgggcagcgccgccagctcggacagcacctccagtccatccatacgggcaagcacgaaatccatcaccacgatgtccggggagagctcctttgccaggcggaccgtctcctgcccgtcccctgtctctgcggccagctccaggccggattcctcctccagcgcacccgtaaagacacggcggaactcctcactggcatcggccaccaagatcctctttctggtttccaatattgacaccctttccagcaggtttccctgccctatgtttgctgcctggccaaggctgtttaccggttgcctataatttaccataatcagacagcaaacgcaagggtttttctggtaatttatgggtatttctcctcgacttcattcgacctttttacgaccgttacgactggttctccccattttccgcctccaggagcatattctccgccaaaatgccgtagccctgggtgggatcattgaccaaaacatgggtcactgcgcccaccagcttgccgttttgcagaatggggctgccgctcatgccctggacaatcccgccggtggtttccagcaggcgggggtcggtcaccttgagcatcaggttccgggtatccgcgccgttggcgggatacacccggataatctccacctgatactcctcgacctggtcgccggcgatgttggagagaatcgtggccgccccggtcttgacctccttgcgctccgccacgggcaccggctccaggccgtcggtcagcgtaccgtcttccaggcggccaaacacgccgctggcagtattggcgtacagctcgcccagatcccggttcacctgaaacgcgccgtggagctcgccgggggctcccttttcccccttcttcacatcggtgacctccgaatacatgatggagccggactggagtggcatgagctgggcggtgtccacgtcgttgatgccgtggcccaaagcgccgaaccgcccggtagcgggctcgcagaaggtgagggtgccgatccccgccatggagtcgcggatccacgcccccagcttgtattggccgtcgctgccgcactggaccgcctgagcggtgagctgtacggtcttgtcgtcccgcaccgcccggatgctcatgggttttccgcccacctcctggaggacactctgcacctcctcgatgctgtccacctcctcccggttgatgtgcgtgatgatgtcgccctcccgcagtccacagtcccgggccggggcgctgctgccctccgcgccggccacctcggaaaagcccaccaccattacgccgtcggaaaagagtttgatgcccaccgcgcggcccatggggatcaccgtccgctcctccgcggcccgggccggggccgccgataccaatgacgccagcacgaacatcaccgccaccgccagggccgcccatggcctcgttttggattcctccttcatttgaccaccccttttttgaattgaaacgtgaaaaacggcgcacgctgcgcgccgtttttaatatggccggaacgcgcgccgccgcctctggcaatgaaacgctcctttggcttgtcgtttccttccagcgccggccccgtcggccttcctccttttattccgccagatttcccctttgtcccggcaatttcctgtttccgttataagaagattctggtaaagtgcaaggtaaccaaaaattggcgagcggttcaaaccgaatcaagctctttattccgggagcctgttggccgcccgcgccatggaagcgggcccccccgtcgccgctgcctgtgccgccgggctgctggcctcggaatacaaagccgcacaggacccggaccctgtgccgtgcagacattccctgcccctgcggggtatgtccgccccgctctgcgcatatactccactatcacaaaacagggggtatcgctatgtcccgtttgtccaaggcggcgctgatcacctttgtggtggccacgctggcgggctcctgcctgcacttcctctacgctctctggcccaatggcctgaccgccctgctggccccggtcaacgaaagcctctgggagcatgtgaaaatcctctactggccctgcctgctctccggtgttctgctggtgcgcagggagccggagagcctgggcgcccgcgccttctccctgctcctctcggctgcggtcatgctgggcgtgggttacctctatcatgtggtgctggagggtgattccctcttttttgacgtggccctctatgtgctggtgatggccgcctttttcctgctgccctgtttcctccgcactcccgtctggagccgcacacgcctgctctgggtggtgctggtgctggcgctgggcgccgccacctttgtatttacctggtgcccgccggatggcctgctgttccgggatctctccctgcccgccttttattcgcttccctgttgagtatgagccatttcggccgtgagtatgtccttgtagggccagagggattttttcacagaaaaagacggaacgcacacgtccgtacgcgcagacccttcgccccgcaaaggggacgccgctccccgcctgccccggtacgtctctaccctgtaggggcggggcttgtccccgcccgcgggcggccataaaggccgcccctacaggctgttcagcagaataaaacccccgcgtccgggagtacgccgggtgcggggtttgttttccctgcaaagggggtaatatgcatggcaaagtatacggaacactatcgcctgcaccaatgggagccggaggacagcttcctccgcatggactttaatgaggattttgcaaaaattgattcggcgatcgcagcgcggggaaactgcctccaggtggtcggaacttacacaggagacggcaattacgggaaagggaaggcgacggttctgcacttccccttccggccgctggcggtcatggtggtgggcgggagttaccaagcgacctcgctcttcctgcggccggggacaaagggtgcggccaatgataccgccggtatgggcagcgtgctgtccctggcctggggagaggacagcctgtcctggtatgtgaccggctgggccagtggaggctctacttccggcggcaccagcgcggagggccagctcaacgaaaagggggcgcactatacctacttagtattgggttaaaagagaacccccttccggaaatccggaagggggttcgttatgctttcacaaccgcggtcaggcgatggtgaaggagcaactgccagatacggtgtaagtgttggtgtcagcgttatcacccttgaaggtgatcagcacactgacatcataggtgccggtactgtttgcactgatggtgagaccaggtacggtcaacgcgttcatcacatcagcataggacttcactccagaaagattcttggtgaaggtctgctcatccccgttgttcttggatacagtgaactcgatcacggcatccttcagattccaatcatcaatgtctgcacaggaggcagtcacctttacggttccattctcctcgcggcttgcggagatagaatcaaacttgaagtcggacttgatgtcaggcttgccgccgtccttaccattctcggtgatgaacagggccacaacctcgccgtcctttacaatggccttaaaggcgtcatcgctgtcgcggacggagttgatgctggaggtattgaactcatcgtcctcgatgcggaagacaacaacatccttcgcataggtgtagtaggtggtggagccattctgggtcaggcccacggtaccatcggtggtcttcttggtgcccacgccggagatgtagtagtcgtccttcttggtgtcattctcgtattcggtgatcttggtgaccacgtccttgctgttgatggtcagtctgctggccacgatatcgttcttgatattcttctcagcataatccttctcgacgtcgaccgtggtgatcttgccgtcgatcacagcgtcgtaggtgtagtagtcgcccttctcgctgtcgctgatcagcttggactggctgccggccaggatatagatctgagccttgttggagtcggacaccacatcggaggcggcggagataaagacatacttggccacgctgccgggcttgccgtccttggagttcacatatacggtggccttgccgtccatgctgggcacattggcaatgccggtgtagacgctgtactccttctcttcctcgtcatagaccaggaagatggtgctgctgttggcgtagcgctcgccacccttattgttggtaccgttgatgtcaaacttggaggtgcccttggtcaggtagatggagtcacccgcatcggaggtcacatccttcgctttcagagtgtagatgccatcgtcatccacggtgtaggagacaaatttgttcttaaaagcagaagggttcttgtcgtctgtatcagcctcgatgacagtgccatcagtcaggagcagcttggcggtataggtcttgtcggtgtcgccgtcccaaccttcattatttgtcttgaaattcagcacgaaagcgacgctggcggagccagcctcatactcctccacatacaccacgtagccgtagttatcggtataaatatcgacgctgctcttcagcgtgatatcgtaggtgcggtgattcttgttatacttgtaggtttcaccgtcggccacaaacttggtgtctccggttttggaggtgacttcctgatcctcgatcttcttcgccatggtcacggtctggatgtcgccgtcggccacggtgtagagcaccacatcatcctcatcaaaggaggcgttggtctcaaacttaccaccgttgccggtcaggccggcgatctcgatgtagggctcctcgtcctttttcacgctgtcagcgtcgaccaccttggaaacctcacccacataggtgttgataaccacgagggtcacgttgtcatcgctgtccacaaaagcctcgaccagaacgccgttgccgctggcctccagcttggtgtcgtcgcccttcttcacggtgaagtcggcggcggtcttaccgtccacaatcacgtcggccttggtggtctcgcccaggcccaggtcggagtagatggtcttggacttgacttcctcggtgtaggaggcatcggcggtggaagcataggtgccgatctccttggagccgttcttccactgctcggagggacggccgaagtcatcgctgccattattgttcacagacagatcggagaaatacttctcgcagaactgctgcacctcgtcacggtcggcggaaacggtgcggtagtcgtcggtcttgctgttggcgaccttcacaggggcggaggcgcccacaacaacctgagtgccgtcgggagtgttgacagtggtgcccttgttggtgtagtacaccatgtcggcggtcagggtctggaacgccatctgggcggcctgctcacgggtcatggcgtcggccagcacgatgcccttgggggcgatgcccgcgttcaccgcgtcggcggccacgttgatggcccagtcgttgcccacatagttggcaaccttcgcgtcatagcccagggccaccagcatcatcttcgcaaaggccaggccggtcagctcgccctcggggtcgaagttgccgttgccggtccctgccaggatgccctgctgtacgcagtagccgatgtagcccgcagaccagcggttggccgccacgtccttgaaggtggtggagttggtgctcagcttattggcgtcctcctcgcccaacagcatgacagccacgatcttggcggcctgctcacgggtcaggatgccggtggggttgaaggcgcccttgtcggtgccctcgaatacaccgatggcggtcatcacatcaaccgcctcagtgttggtgatttcagcagagtcgttgaaatcactgctcacagcgctggcggagacgaccatcatgcccacaatcagggccatggccattaccaggctgagagtccgcttgaggtttctcatttggatttcctccttctgaattttgaagcctaggggcgtatgacgccccttgcaagccatgaaaaaggagggattcgccccacatgcagttccaaatggcacaaaagagcggcaaaaagtggcgttggtagacatctggtagacacgccgggcatgccaagcgcaaaaagagcccggaaccacaacggttccgggctctttttggtagacatttggtagacattttcctcttacgccgcctgcttatcctgctccatacgcaccagcttgatacaggcgccgatgacaccgaacaggaaccagtaggtaaacatattgcgggggtaataccaggtgtactccgccacgccaatgaccagtataccgcagaaggcgccaatggcggcggccatcatccgcttcacccgggggtccagggcggcaccgaagcctttcacacccgacttcagttggtagagcagcagagacaggtaggccagcagaccgagtatacccgtctctccccacatctggagataattgttgtgggtatgaaccggataggagccgtcgaagttggtgggataggtctggaagaccttcttcattacatcggtgcccaggccaacgccccgcgcccagtagtcctccatcaggttcctggtagtctcatagataccgaaacggtactgaaccgaactatcctctccggcgttgaagatggtgaggatgcggttgtagatggtctcgggcaggaaggggatggcggccagacccaccagcaggaagaccggcacccagcgccagttcagcagggccaggaagaccagcactgccccggccaggccgatccaactggcacggccgtaggttgccccgatggccaccagccccacccccagggagagcagggaaaggagcttcccccgccagtgggaattgaggaagagcgccaggttcaggggcaggagcatggccaactgctcggcaaagttgttggggttgtcaaagaaggagtagacccggcccggcatgccctgattgaggttcatatcctgctgggaagccacgatatccacgccgatatagctctgatagcagccgtagagggcggccaccgagaggcccagcaccgccagggccaccatgagctggagctgctcatacttgcgcaccatgctgaccaccagcagcaccagcaaaaagccggtcaggtggaaggcgaagaagcgcagggagaggcgggtggacagggagcccgccagggcgatacagataaaggccatatagagcgtcatatagggccccagggtgtccagctccagccggtgtttggggcgcgaggcactgcccaccacaaaaagcccggtgagggctaccgcacccatcaggccgtagacgttgttccacatagcatggggagtcatgagcatgaccatcatgaacagtcccaggaagaggaaggaggccccgcccagcgcccctatcaggcggcagaacagactggcgtcccacacccgttttcccgcccggtagacggccttgaaaagagcgcaggggatgttgatgatggcggtaaacaggcggcaagcgatgctgtggggccacgccctggggatgcggccctcccgccagacgaaggtacagatggcgctgttctccgcctgccggagaaaccatccctccagccggtcgcagacccgccccagggcactgttggcggccgcgttcttcaagcacagccacagggacaggaaaaagcggacaaagaggctgttttcagtaatagacataaaaaataatactcctagcaatcaatcgtggagggctttttcatatacgccgtaagtggccctggccattttgtggatttcaaacttgtcctcgatggtcctgcgcgcgttctcccggcaccgggctgcgaaagccggatcctccaggaagcatttcatggccacggccatggagtcggggttgtcgtactccaccagcatgccgcaccctgcctcgtcgttgacgatgtcggagttgccccccatgtcggtggcgatgacaggcagcccggcggccatggcctcgatgatgaggaaggacagggcctcgtgctgggaggagttgacgtacagatccgaacccttatataggttcttgatgtccttgcggaagccgatgaacttcacgcagtcctccagccccagctcctgtacctgggcttttgtaggctccagcagggggccgtccccggccagcaccagggtgaagggcacggcgcacagctcggtcagccgcttgaccgagtcgatgaggtacttgtgccccttgtccccggcaaaccgggaggcgcacagcataacgaagcggctgtcgtccagccccagctcggcgcggagggtggactggctgcggtctcccgcccaggcgtccagatccacggcgttgaagatgacctggatgcggtcggcgctccagccgttggcgacgagctgctccttccccttgttgcacacggcgatcatctgatcctgccgccggtccatgatgcggttggagaagcgggtcacgaagtcgttggccaggacaaaatggttggtatagaccacgcggatttttttattgtacttcttggccagcagggcggtgtagtgctcccgcagatagtggcagtgaaccaggtcgatgtcccactcggcgcagagcttcgccagttcacgggcggcctttttgtcgaagcggcggcgcatctccacccggcggcagggcacgcccatggcctccagccgctccaccagcagcccgccctcgttgtaggcaaagaagggctgtaccagcccatcggcggcgagatacttcaccagggtctccacgtaccgctcggtgcccgccttgcctgcaaaattcagcagatagagtaccttcagcatgaagaataccccctttatccaaagagtaagcgcggagccatgccccgcgcctttcattttaccggaaaacccccgggaaatcaacccgcttttcgcccccagccgcagaagatcagacccccgcagagcagataagggatggcggactcatgaagggccacaagggccccgtgcacaggcaacagcagcacgcccagaagaagcagggccgcgcagcccgcccccgcccagaacagggcacgccggagtgccagccgccgggggcggagctcccgccagatagagaccagggcgcacaccgccattcccagcagcagattcagggcgggccagagcagcagccagcccgccgcagagtagtcatatttatcgtacatcgcctcaagcgccgggagcgcccagagctggtaggccagccacagcgccgcccagacggcccacagcgccccggcggtaaccgtgcgcctccgccggtttgccggggccgccgctccctccgccggccggggaccatagagcagctcgtccacgccgacccccagaagctccgccgcggagaggagtatctccagctcgggcaggttccggttccgctcccagttgctcaccgcctgccgggccacgtggagccgggcggccagctcctcctgggtcagccccctctgccgccgcagacacttcagattgcgggcgatgtcgtgcatacgcctcccccctctcccctccatcgtagcagagaacctcccgtttgtcacgcaaggcccgcttgcacggggaaaaacggcggcggggcgggcctgccagaacgcggcaaaagcggcgcgtcagggatgccgcgccctacacagggcgggaaggcggcgggcatgaccgctccatgacaaagttggtgaggagcaccccccggcgctccacctgctgctccttcaccacatgccagccccgccgctcaaagaagggccgggcggtgatggaggcatgggtgatgcgggcggcggggagggcgtcgcagagggcggaggccacccccctcccctgccagtccctgtggacatagaggcggtccaggtagccgtccggcccgagatcggcaaagccgacgatcacgcctccctccaccgccacccgggtgtcgtgggcgcggaaggaggcgtcccaggcggccagctccacccggccatccgcccaagcgtcgagctgctcggggctgtagtcccgggcgttgacggcgtgaaccgtttgataaaacagctccgccaaggccgggcagtcggagctgcggtaggggcgaatgtgcatgcgttacctccgtttccgcagatgccgcccacggttcagcaggcgctccccctggtcgaagaggcccaacatgaagcgcatgatggagtaggccagccccaggaacaccagcagcaccaggaaggcctgcgtacccagggggctgaggccgaagctgccaccgaagccgaggattgtcaccgccgaggagcccgccatggccccccacagcacccgccgcttccagtcaaagggcttgcacacctcatagagcaccatgatgccgatgacgatgaggaggatcgccgacatggtggacagctccgcctcgctgaagccgaaggtgaggaagaagacctccacccccagcaccacgaacaggtcggtcagtccgccgggcagggcggcgcggaacacgttggacaggaacttgccctttaccagactgtggttgggctccagggccaggaagaaggagggcacgccgatggtgacggcgctgagcagggagagctggaggggggtgaccggataggggaaggtggcgaacagggagatgagggccagcaggaaggagaagatattcttcaccagatagagagcggcggcccgctggatgttgttgatgacccgccgcccctcggccaccaccttgggcatggcggagaagtcggagttgaggagcacgagctgggcggcgtggcaggcggcgtcggagccggaggccatggcgatgccgcagtcggcgtccttgagggccagcacgtcgttgacaccgtcgccggtcatggccacggtgtggccctgccgctggagggcgcgcaccagcttgcgcttctggttgggggtgacccggccgaagacggtgtactcccgcaccgcgcgggcgatgtcctcatcggagcggagggtggcggcgtccacgtacttctccgccccctcgatgcccgcctggcgggccacctcggagacggtgacagggttgtcgccggagatgaccttcacggccaccccctgctcggcgaagtagcggaaggtcttgggggccgccgggcggatgcggttggacagggccaccagggccatgggggacacccgccgggggtccagccccttctgatcgggcaccccgccgtactcggccaccagcagcacccggtagcccttctctgaccaggggtccaccgcctccttcagatcggcgtagcggttccccatgatgaactccggggcgcccaccacgaaggcgccgtggccggggaacaccgccgcgctccacttggtggcggaggtgaaggggatggtctgggcggcgtgccacagggacttgccgtggaatttctgggccatggcccgggcggtgtcgttgtccgcctccatggactggtaaaaggcgttaagggtctcggtgaccacagtctcggcgtacttctcctcgtccaggtacaccacctcccctacctccatgtggggctcggtgatggtgcccgtcttgtctacgcacagaacgtccacccgggccagggtctcgatgcagttcatatcctgggccagcaccttgccctgggccaggcgaatcatgctcaccgccagggccacgctggtcagcaggtagagcccctcggggatcatgccgatgagggcggccaccatggacaccaccgcctcctgggcggtgcgctccaggaagacgaactccttgacgaacagggccacgccgatggggatgagcaggatgccgatgatgcggatgagcttgtccagggaggacatcatctcgctcttgcccacggtgacatccttcttggcctccagggtgaggcgggcggcgtaggactccgcccccacccggtccagccgggcccggcagcggccggacaccacgaaggcgccggagagcagctcgtcgccgggggccttggtgatggcgtcggcctcgccggtgatgagggcctcgttgacctgcacctggccggagaggacggtggcgtcggcggggatctggtcgccggaggccagctccgccacgtcatcccgcaccagttgggcggcgggcacggagatcaggttcccctcccgcactacgttggcccggggggcggccagcaggttgagcttgtccacggtctgcttggagcggagctgctgaacgatgccaatgccggtattggccacggcgatgagcagaaagagcatgtcgtcgaaggagcccaccgccaccagcagggccgccagcaccacaaagatgaagttgaagaaggtaaagacgttttcgcgcacgatctgccccaccgtcttggtgggggagtccaccgggtcgtttgcccagccgttctgctgccgctcttttacctggtgcagggtgagcccctgctccggatcggggctgagccgggccacctcccgccggggctggggggccgggacctgcgcggccggctgctttgtgtgcttgcgtttcatgcttccgcctctgatttcctcaaaattcggtccgatacctctgtagtatagtggatcgcgccgggtgggacaagtacgccccctcaaaatttaccgttttttcacatccgaagcagcctgctggtctacccagccctgtcccccgctatacatggagagaaggaggcggcgcctatggaaaccaaaccggacaaacaacagaccgtcacccggctggccctgtgcgtggtggttgcggtggcgctctacgcggcggccgggaaagtcccgcccctggagccctaccgtccctggctggaggagcacaaggtacaggccatcgccatcacggcggccattctgttcgggctctccctgctccttttcccgccggaggagggcggggcagagccagcggccccggaagagggcccctgcgccgggtacgaaagaacggaggacctgccgtaagggaggtcctccgttgacgttgcggcgccggagcggagttcagccctggagctctaccggaacagcggcagcagcgccgcgccaatgaggcccgcgtcgttgcccagggccgcccgtaccagccgggtgcggtggaggttgttgcgcgcgtagtcctcccggttgaggatgtagcgcaccggggccatcagggtctccccctgggcggaggggccgccgccgatgcagatgacctccggctggaagatgttgaccaggctggccaccccgcagcccaggtagtccacatactcgtcgatgaccttgcccgcggcgggatcgccctgggcggcggcgtcaaaaggagtgcggccgttgaccccctccaggctccccgccagctcccacagcctggaggtgcggtcctcctccatcacctggcgggtgcgcttgatgagggcggtggcggagcagtaggcctcgaagcagccccggcgtccgcaggtgcacagccgcccgccgtgctcgatgacgaagtggccgatctccatgcccgcgtaattgaagccggtgtagagcttcccgttgaggattgcgccgccccccacgccggtacccagggtgacggccaccatggactggctgcccttgccagcgcccgcggcgtactcccccagggcagcggcgttggcgtcgttctccagcaggatctccttgtccagccgcgccttcatcagggcggtgatgggcacattggtgaagtccagattggaccagtatttgatcacgccggtgtccggctcaatggcgccgggagcgccgatgcccaccgataccacctcgtccagcgccgtaccggcggcctccgccgccccgcgggcggccgcggccatctggtcggccaccgcctccgcccctctcggggtgggcaggctcaccttgcccaggatggtcccctcgctgtccaccacggcggcggccacgttggtgccgcccagatcaattcccaaatacttcatagcttgcccctcctgcgtgaaacgtattcacattataatgcaggacgggccgccgcacaagagggaaaacggcgctcaggtgacaactgtgccccgggcggtcttagggagccggggggacaccgccacaggctgccggttccgggtgcgcaggtgcaccagcagcgtgacgcagccgctgagcagcaggaaggaatagaagctgatgccccgggagaccagcaccgccggggtcaccagtccggcgccgaagaagagcttcatggctgccacaaagccgccctcggaggcgcccaccgccccgggcaggggcagggaggccaccgccagggtgaccagggcctgggtgccgatgatgtccagcgccccgctgccggtcaggccgaaagcgtagtacaccaccagcgggacggaaaacagggcggtgagctggcagaaggtgaggcccagcagagcaggcaccagggcggggttgcgcctgacgcagtccgccccccggcggtactcctccatctgcttctccagcttctccctggcctcctccgggcggcggaccagacggacgcgcaccagcaggctcagtacgccgccagtgagccttctggccgcattgggcaggaacatgaggcagagcatccccgccgtcagcgcgccgttgaccaccgcgccgaacagcaggagcaggcccagcccgccccccaggttggccaccagatcaaagcggagcagcgccaccgccagggcgtagccgatgaccaccacctgataacacacggcgatgagcatcatgttgagggccccgtgggcggcgggcacgccgtccctggacatgtagtagatctgggcgggctgtccgccggtggccgacggggtgatggagctgacatagaagcccacgaaggagtagcccaggcagcggcggaggggggcccggtggcccagccgtcccaggatcaggtgggagcacgtggcctcacaccccacgaaggccagcatgagagccagccccagcagcagccagccgggcctgagctggcccagggtgtggagcagccgggtaacgggctggtccctgaacagcagccagccggtgagggccatcagcgccgcgatcaggccgatccccaccaaggactttttccggttcatccgacgcgtacccccttctcggcctccaggcccgccagcatgcggttgaggctctcctcctccaactgtcccttcatggcccgcatgttgcccgccatccactccagcgtctcgtcgtcgtagatcagcgcgcgaatggcggacaggcactcctcgggctccttggccgctacgcggccaaggccccgcttcaccaggaagcgggcgttgttcttctcctgctccagaaagggctcccacgccaggatgggcagctcggagaagatggtctcaaacagggtaatgccgccgggcttggtgagcaccagatccgcccgggccatgtagtcgtatacccggtcggtgaaacccagcacctcgatgtgggcatacttgcccgccaggcggtcgtagagcttgcggttgttgccggtgataatggtggtgtggacgccgggcagggcgtccagcgcctcataaaagctgtcccgcttgggcagcaggcccagcccgccccccatgatgagcaggttgcgctcccggcccgggcggcggcgcaccggccgcttgaactcgcagcggacggggatgccggtgacgcagatgatgtcccggtctacccccttggcggccaggcggctgcggatgtcgttggagcccaccagatagcagtcggtgtatttgtgaatccactcggaatggctggacaggtcggtgacgcaggtgatgaggggcagggcgctccccgtctcccccttccagcgggacaccatccgggcgcagagggggtgggtggcgatcaccgcgtcgggccgccgggcggcgacaagctcctccagtttgtccaggaacaaagtctcaaacagggggcgggcgtcggcgggcagatcctgggtcagcttgtagtagaggttgaacagcccgctgccacgggtcaccagcaggttgaagcacttatacatggcctccgaggcgttgggcatggcctccgccacgaagtccagcacctccacctccgccccggggaacgcccgcagcagttgctggcgcagggactgggaggccgaccagtggcccatgccgaattttccggtgagaatcagaatattcacggtgttccctccttttcatatatcagtataaaggaggattctttagaaaacctcgctcgaattcttaaaaagccattaagaatttctaacaaagagctccaacgggccctgaggggttgggcagcaggccgccgcccgccaggtttcgccggaaaaggcggaaaagaccagcccatccagctctcccgtctcccccggccggaggagaggaacggcgatgtcccgggggggccgccgcagaccctccccggtgcatttgaccctggcctccttcaacgtccagagggtgtaaaacgccccccagtccccgccctgccgctccagccaggcggattccgcctccgagcacacataccgcgccagcccggggcggcgggggcgcagcacctccacgtccacccccaggggggcctcccccgcgccgcagagggccaggcccccgctgtggctcacattgaagtgcagctccggctcccccggaaagtaaggcttgccgtccgccccccgcgccatcgccgggagaacccccagtccgtactccgcccgcagaagctcccccagcagggcataggcgtccccctcccccagccagagcaccatgtccaccgcctccttttttcctaggataccacaaaacggggccatttggtaggggcggagcgatgtaggcagaaggggaatggccccgcagggcaagagaagccgccctggggcgtcgccctctacggacttccaggggcggcgaacgagtgtgtgcctgtgccggaaacgtaggggcgggtgcccacacccgcccgtattcgacaaggccgcgcacaccacccggcgcgaaggggcgggcggccacaagggccgcccctacgggcaagcttaccctcctctggcattgtaggggcggggtttatccccgcccgcaatcggcggagccgcgcacaccacccggcgcgaaggggcgggcggccacaagggccgcccctacgggcaggcttaccctcctccggcattgtaggggcggggtttatccccgcccgcaatcggcagagccgcgcacaccacccggctcgaaggggcgggcggccacaagggccgcccctacgggcaggcttaccctcctccggcattgtaggggcggggtttatccccgcccgcaatcggcagagccgcgcacaccacccggctcgaaggggcgggcggccacaagggccgcccctacgggcaggcttacccccctccggcattgtaggggcggggtttatccccgcccgctagggccgctcaaaggtacccagaaacagcggtacgccccgctccaaatctaccacggcgtagcagaagggccggtcgagcaccagctcccggtagtctgtgggcgcggccgcgtcctctacctccaccacagtggccgcggcagcctcggtgcccttctcgttgacctcgatgcgggccttgtggacgacagaactgacgtacagcggcccgtccggcgcggtgcccagggcggaaaagtcggcccggccggaatcgaaggcggtctccagccccatggcggccagggcgtcggacagctctccgccccactccgcctcgaacttgggcagccggagaagcacccgctcctcctccgcggccgccagcagggcgggcagggtatccccgtccagcgtctccagccaggcgtccagctccccgtcggggagcacggccaggaagcccagccgcccgtcgtcataggggagcaccaccccggcggccccctccgcggcgaagtattgctcggcacgcaggccgttggagaggaaatccgtctcggcttcgctcccgtcggcggcggtgaagtccccggggcgggtgtccagcggatcaaattcgctggcccaggcgtttttcaggtagagggcgttgaccagcagcaggacggtctcgggggcgggcgtttcggccagcacctccgggatcagcccgcgggtgacctcccctacccagttgttcaccgcccggcgggccccgtcggtgtccagatcggcctgatagagccgggccccatagaacgccgtacaccgggagagaaataattcgttggcctccagccgcccgtccagccacaggctgtcggcgatggagcactccgtggagccccccagggcggcgtaatcggccagcagggaggcggcgttggcgttgagggcctccacgtccgcccccagcagggcctcgaactccgctagggtgtcctccgcagctccgttggtcgtcatggacagggccagggccacagacagcggggagagcagggtgttctcccccggttcgcgggccgcccgcagcagctccgcccccagggtgccgatggcggcgtccaccgccggatcggcctccgggggcgcggggtcgcccgcctcgaactgccgggacaggtcggtcacccccgccggggcggcgcacccggccagcagggccggcacaaggcacagggccagcagctttcgtttcttcatggaacaccctccttttataatatggtttgctttttagacgggttctggggtaaaatgttccggggtcttaaacgctttttaaagattttccccctcgccccttaagcttcgtctgctatactgactttacaatctgaggtgactgtatgaataccatcctgatctgcgacgacgacaaggacatcgtctcggccctggacatctacctgaccagcgagggctatgccaccgtgaaggcctacgacgggcaggaatgcctgtgcctggcggagcgcgagccggtggatctgatcctgctggacgtgatgatgcccggcctggacggcatccgcaccacggccaagctgcgggagagctgcaacgtgcccatcatcctgctcaccgccaagagcgaggacagcgacaaaatcctggggctgaacatcggggcggacgactacatcaccaagcccttcaatcccatcgaggtcatcgcacgggtcaagagccagctccggcgctacaccagcctgggcggcaagcagggcggcggggaggccaatcccaccctgctcaccaacggcggcatcgcgctggatgacggggccaaatcggtcaccgtggacggggagggggtcagcctcacccccatcgagtacaacatccttctcctgctgatgaagaaccccggccgggtgttctccaccagccagatctatgagctggtgtggaacgacccctccctcggctcggaaaacacggtggcggtccacatccgccacctgcgggagaagctggagatcgacccggccaacccccggtacatcaaggtggtctgggggctggggtacaagatggaaaaggtctagggggcgctcgctccggccgcaccccgcccatattccaggaggtaatgccatgaaacgattccgaaccagtctggcggccaagacggccgccgtccttctggccctggccgtgggcgccggcggcttctggtccactgtctttatcctctaccagtgggataccctgtggctgggcagcgggtattacgacagcaacgactattactccgacctgtataaccgctccagtcaggtgcacgagctggcccggctgctccaaaaccaggagtggaacggcgccctgccctacctggatcagcggcggctggacatgctggaggaggccctctccccggagcggaccaacttccgctttgccatccggcgcaacgacaccggcaccctcgtctactccaacctggagggggcggcctccctggacgagagcgttcacgccgtggagcaggaggagctctccctcacccagaacggggccgcccgcgagcaggattatgtggtctggaacgggaaggagcagtactacctcctctatatcgcccttcccgacgccgctggcaccaagcagctcgtcaccccggaggatgccgggctcgccgcccaatacggctacacctttgacggctatacctggaactatgacgagcagatggacagccgggtgaccacctccgtgctggccctggaatacggcgcaaccgacccgctcaccgtccaggacgagttctgggacagttaccaggactaccagcagtacgccagctacctccccgccctggcggtgctggccctggtgctggacatcgcagggatactcctgctggtgtttctgctccgggccgccggctggcggaaggaggagagccgcccgaggtgcaactggttcgaccgcatcccgctggatctgctggccttcggcgcgttttgggccatcgccctccttctcaacgcgggggacgcgatcgccttcggcctcaacgtatcccaactggccaccgacctgctggtcggcatgtgtgtcatcaccgtagccattctgggctgtgtcctggccttctgccttaccgtggccacccgcatcaagacccgcaccctgtggagcaataccctcatctgtatgctgtgcaagctgatcgcccggggctgccgggcggcggcccggagctggcccatgacgggccgggtggtggtgctctttctgctctacctggccggcaccctgctcaccacgctgaccatcttcctcatccccgtgtttcagggctttgtgctctactgcctctgccgctggaccatccaatggaagcgggtgcgggagggcaccggccgcatcgtggggggcgacccggacttcaagatcgacacccacaaaatgtacagtgacctggcccggcacgccgggcagctcaacgatttgggcgccgccatcggaaatgccgtggacgagcgcatccagagcgagcgctttaaggccgagctgatcaccaacgtctcccacgatctcaagacccctctgaccagcatcatcaactatgtggatctgctgaaaaagcaggacatcgacaatcccaaggcccaggaatatatcgaggtgctggaccgcaagagccagcgcctcaagaagctgacggaggatctggtggaggcgtccaaggcgtccaccggaagtctgtcggtgcacctggaccggctgggcatggtgcagctcgtccagcaggccctgggggagtttgaggagaaatttgcccagagccgcctcaccgtggtgcccgccttcccggaggaggagtgctccatcctggccgacggccgccacctgtggcgggtcatcgacaacctgctctccaactgcaacaagtacgccctggagggcacccgcatctatgtggaggtgtgccgctgggagggcaaggtggtcctgtccatcaagaacatctcccgccagcccctcaacatccccgccgagcggctcatggagcggttcgtccggggggaggagtcccgcaccaccgagggctccggcctgggcctgtccattgcccgcagcctcaccgagctccagggcggcaccttccgcctggacatcgacggcgatctcttcaaggccgtggtctccttcccggaggccgccggaccggagctgcccgcgaacacataggaggcgggcggggataaaccccgcccctaccagtttgtaggggcggcccttgtggccgcccgccgtcccccaatgcaaacaacgagaggccagccccgaagggctggcctctcgtttgcttctgcaattagtcggtcacgaagggcagcagcgcgatctgacgggcgcgcttgatggcctcagtgagctgacgctggtgcatggcgcaggtgccggtggtgcggcggggcaggatcttgctccgctcagacaggaaccggcgcagcttgaccgcgtccttgtagtcgatgtgctccaccttgtccacacagaaggtgcagaccttgcggcgcttgcggccgcgggggcgctctctatccatagccataacagggaacctcctttttcacgggccttcagcccgtcttgttttattgctgcgcaccgactgtcgtgcgcaaaatgtgttagaagggcagctccccgtcgtcgtcagagagctcggcgaactgatcgccgccgcccatgggggcggagtagccgccgctgggcgcggcgggaggcggcgcgtagccgccggccggagcgccgaacccgccggagggcgcggcatagccgcccgcctccgcgtcccgcttggagtcgccgaagtacacgttgtcggcgatcacctccgcggtgcggcgcttgttgccgtcccggtcggtccagtcccggagctggagccggccctccaccacggccatacggcccttagtgaagaaacgggagacaaattcggcggtctgacgccaggccacgatgtcgatgaagtccgtggacttctcgccggtggtcttgtccttgaagtcccggtccaccgccagggagaaggaggccacgggggtccccgtctgggtgtggcgcagctcgggatcacgggtcagacggcccatgagaataatccggttcagcatgtctgccgctcccttcttacttctcgtccttgcagacgatcagggaacgcatcacgccgtcggtgatccgcaggatacgatccagctcacgggggaactcgggcttagcgttgaaggtcatcagcacgtagtagccctcggtcaggtcgttgatgggataggccaggtggcgcttgccccactcctcaacctcagccagggtgccgttctgctccaccagggtcttgaacttggccaccatggcagcggtggcctcctcatccaggttgggattgaggataaagaccacctcgtagtttccgctcagttttgccattttctttgcacctccttatggacgtatggcccccgcccttgtgcgggggcaaggatggcctgttttgaaacaagctatattattatataggaatcagcgaaaaagtcaagcctttccaaaaaaataatatttttttgcttccgtgcaataaacggcccctctgcttcattttactgtcagaacgggcgggaaaccccgccgcagatttgacaggataaaggagttttgatgatgaaaaagggttttggaaaaggcttttgcagtggtattctggtggctgccctgacggtgggcctgggtgtgtcggccatggcggccagccgcaccatcaccgtggatgacaacatccgcatcaccctcaatggtgcggtcttctcccccaaggacgccaagggcagggatgtccccctgttctcttataacggcaccacctacgcccccgtccgcgccatctgtgaggccgccggcctgaaggtggactttgactccgccaactataccgccgtcctcaccacccccgaccgctatatcgcctccaccccctccgcctccaactacatctccgtggacaaggccaaggagatcgccctgaaccacgccggcgtgaaggccgccgacgccatcttcgtgaaggccggactggactgggacgacggccgcaccgagtacgaggtggaattctacgccgggaacacggagtacgattacagcatcgacgccacgacaggcgccattcgctcctatgaccatgactgggatgatttctccctgtggaatcccggaaacaacgccgccaacccttccacccctggcacctccaccaacaatctgatcagcgaggccaaggccaaggagatcgctttggcaaaagccccctccggcgcctccgtggtacgctgccacctggactgggacgacggccgctatatctatgagatcaagatggtctcgggcaccatggagtatgagtgcgacatcaacgccgccaccggcgtcatcaccgactgggacgtggacagcatctacgactaattcctttcgcaaaccgctccgtacccgaaagtaccgtcaggcgctgccgcctgacggtacttttttgcgtctgcgttaaaacagctccggatgctccagaagccagcggttgaccatggccataaaccactccacggccggattgtcactgggctcccgccacgccacccccagctcgatggtctgcccatgcccctccagcgggacaaaggccaggccggtggtatgcatgtactcccgaatccggaaagggagaatggcaattgcctgtccgcactccacggcaaagatcacatcctccagggcgggatactctgtgaccgacgccggggtgaaacccagtccccggcagatctggaggaactgcttatacatataggccccgccggtgtgggacaggcaggcaaagggctccgtggccagcttggcgtagtcgatcacggcgttgtccaggcaggggtgctcccgcgggcagaccaggcagtagaagtcggcccccagcttgcggcaggcgtagccgttcatccccttcaagtcggagagcaccgagaagctcacatcataagccgccgcgtcgatgcccgcctggatgccggtggcgtcccgccggatgagctccacgcggacctggggatacgcctcccgataggcggcgatcagccggggcaaaaagtggcgggagggggaattgaggtagccgatgcgcagctcccaacatcccgaggactctaactggcgcaggcggcccagggcccgctcctcctggtccaggatgcgcttggcgtcctccaggaagagctccccggcccgggtgagcgacacgttcctcgtggtgcgcagaaacaggcgtgcgcccacctcccgctccagggcggagatctgatgggtcacggcgggctgcgtcacatagaattcccgcgccgtctcggtaaagttccggtaacgggccaccgacacgaaatagcgaagctgctcggtgttcattgcgctccctcctctccctgctcgtattataaattgataacgcttttttatcaatcctggaaaaaacgtgaatttcacttttttcgcccggagtgatacaatttgcccgattataaaagaggagtgatgcgcgtggcgtttcaagtaatgggcgtgaccgccggacgcaaggacagcaactgtgaaatcctgctcaaggaggctcttctggcctgccgggagcagggggccgaggtccgcatgatcgatctgaaggattacgagctcctggactgcaacggctgcaccgcctgtaccatgggcatgtccatggggaagaacaccggctgttccctggcggacaaggacgacaagcagaaaatcatggatgtgatgctggagcaggatgcggtgatcttctccgcccccacctatgatctgatgccctcctccctgtttttgaagttcatgcaccgcaacctggcctatgagtcggccttcctgaccaagatcggcgccatcgcaccccgggaccgggtgggtgcgctcatcgccgtgggcggctccacccgctcctggcagtccatggccctggagtgcatgcaggccaccacctttaccaacagcttcaagattgtggacatgtacatggccactcaggttcccgcccccgcccaggtgcttctctacgaggagaaggtggcccgggtccgggagatgggcctgaacgtgatgaaggccctcaacacgccccccgccgagcgcaagtggctgggcgatccggactacggctggtgccccaactgccactccaacgccctgtgcctgggcgagccccagtggaaggggctgcagtaccccatcgagtgcgtggtgtgcggcgcgggcggcaccctggagcagaccgaggacgggcgctggaaatttgtcatcgccgagaacgggctggagcgtgaccgcaccaccgaggagggccgcggggttcactgcgacgagatcgccgagacccagggcggcttcttcatggatccggccaagcgccagctggtggccgagcgcctgcccaagtaccagagcatccagttccccggcatctaaggaaggagtctgattgtcttgaaattcgagcatctgttttcccccatgcaggtgggtaaggtgacctaccgcaaccgcatcgtcagcgcccccatggccttcggcctcattgttcagaacccggatgcccgggacttcacctaccgcaagctggaggccagcgccaagggcggcaacggctgcgtcatcgtgggcgagaccgacgtaaactttgtggacgccgtgcgcatccccggcttccgcccctttgactttgccaagcccgaggaggatcccgagacctttgacgccgtgggcgagtatgcccgccgcatcaagcgccacggcgctgtcgctctggccgagctggtccactgcggcaaggagaaggtgcccttcggccccgggcaggaggccatcggccccatcgagaccaccaacctggccggcgtgaaggtgcgccctatgaacgaggacgacatggcccgcatcgcccgcgacttcgccgtctccgccacctacatgcagaaggcgggctttgacggcgtgctcatccacggcggccacggcttcctcttcacccagttcctctcccccctgatgaacacccgcaccgacagctacggcggctctctggagaaccgcgcccgcttccccctccagattctgaaggccgtccgggaggcggtgggccccgacttcctggtggagctgcgcatcgacggcaccgaccaccagcccggcggcatcacccccgaggagaccggcgcgttcgtcgccatggccgagccctacatcacctccgtccacgtgacctgcggtatctatgaggcgtcggtcaagtcgggcaccgagagctccatgttccacccccacggcctgaacatcgacaacgccgccatcatcaagaagtacaccaaactgcccgtgggcgccgtgggcggcatcaactcccccgagctgtgcgagcaggccattgccgagggcaagatcgactttgccatcctgggccgccagatgctggccgaccccgagtttgccaacaaggccaagcgcggccatgaggatcagatccgccgctgcctgcgctgctacaagtgcttccccggctcccccgaggagggctatgacgacctgcccttcaccagcgaggagctggccctctacgtgggccactgcaccatcaaccccctggcccacctgcccttcgatcccgacactctggcccccgcctccaagcaggagaccgtgctcatcgtgggcggcggcgcagccggcatgcaggccgccatcaccgcctgcgaccggggccagaaggtcatcctggccgagcagggcccccgcctgggcggcctgctgcggttcaccgacgtggacaccgacaagcccgacctgatgaacttcaagaacctgctggtgcgcgaggtggagcgccgtgacatcgacgtgcggctcaacaccgtgatcacgccggagaacatcacctccttcggcgccgacggcgtcatctttgctaccggctccctgccctcctgtcccccggtgcccggcatcgggcacgcccacaaggccatggacatgtacgacggcaaggtcaagcccggccacaagattgttatggtgggcggcggcctggtgggctgcgaggccggcctcttcctccagaagaccggccacgaggtcaccgtggtggagctgctgggccggctggccaacgagtccttcggcatgtaccgggaggccctgatctgggagatggagaaatgcggcatggccatgctgcccaagacccgctgcctggagatcacccccaccggcgtgaaggtggagaacgccggcggcgtccagaccctggaggccgacaccgtcctctttgccctgggcatgaagagcgtggacatcgcccccctgaaggccgccgccgaggccgccggactcaagacttgggtcatcggcgacgccatccagcccggcaaggtggatcaggccacccgcagcgcctatctggccggcatcgaggtgggccgctgagtcccccgccccggaataaatcaacccctccggctaagccggaggggttctgcttgtcggaaaagcggcaagagccactttttcgagggagatgcgcgcaagatgaaccttgattcccgacggaaaagtcggctcatcttgcgcggaaatgactgattttcatgttattcctgcggctgtggccgcaggaattctgcgaggctttccttcctggaaggtttttcgcccgtctgcggcgccccaggcaatgcctggggcgccgcgtttcttttgttcttttgtcagcgctcctggcgcagcgtctcggccttctccttcaggaagcccttgagccacgcaccggtggccgggtgatccagggcgaagtcgatggtggcctccaggaagccgcagaggttgccagtgtcataccggcggccctcaaagtccacggccaccatgcggcttctccggcacagctcccgcaggccgtcggtgagctgaatctccccgccgtaaccaggcttgacgttctccagaatatcgaagatctccggagtcagcacatagcggcccaggatggcgtagttggagagcctctgctcgggggtgggcttctcgttcatgtcggacacgtcgaagatgcgctcctccaggggggagaccttgacggaggagtagcgggagatagcctcagtagccacctcctgcacccccagggcggacgcgccgtacttctcggcggcctccaccagttggagagtcaccggctttttggcccgcatgatgtcgtcgcccagcagcacggcgaagggctcgtcccccacgaagcggcgggcgcggccgatggcgtggcccaggcccttcgtctccttctggcgcacgtagaagatgttggccaggtcggcggcccggcgcacctccaccagctcggactccttgcccgactggagcaggcgggtctccagctcggggtagtagtcgaagtaatcgtccatggcggacttggcccggttggtgacgatcagaatgtcctcaattccggcggccaccgcctcctcgatgatgtactggatcaccggcttgtccaccatgggaagcatctccttgggaacggtcttggtggcggggagcatccgggttcccagccctgcggcggggatgacggccttacgaactttcataacaaaaaacctccagcagagcgggcggaacgccgcccgccgttattgcagatgtgcggtgggaatcatggggcggaaataccgaaccctgggcagggccttcaggagaatcgtgcccagcacatagcaggccacagcctcccctgccacaaaggtccacaggttcagtccatacgccgcccagaaagcgccgttgatagcccctgcctccgcccaagcccacatgggcggcagcagcagggcgttcaccacaatggggggcagggcggccagataccaacggggcatcttgatggagaggaaagctgcgatggcggtggccaaggtgcccacaatcatgtcgatgggaccatagggggagagaatattggtcagcaggcagcccagtgccagccccggcgcggcggcagggaacaggaagggcagcacggtcagcgcctcccccaagcggacctgaaccggtccgaaggtgagctgaaagatgttgccgaagtagcacaggacgaagtagacggcggccaccatcgcggccagggtgagctgttggatgttggatttgcgcatgtgtgatcatacctccattttagtctttagagaacggcggtgagtcccaccgaacgaacgcggccgtggccgcgcttggaccgggtttggaaaccagtcgggggtattttagcacgtttcccatcggaagtaaagaaaaagcgccgggactctcccccgccctcctccgcggaaaaagcagccccggagcgcacgcgctccggggcggtcttttattccgttattccgtaaagggcttttccaccagggagccccggctgtagcgggccagaatgtcccggtcgtccccgtcgtagaggaactgctccagcttctcaaagggggtgcgggacaggcggccgtccagctcatccacatccaccaccagggcgtcgaagtcataccccggctcaaaggaacccaccttcccgaagaattcccccggccccttggtggccaggtagagggcctccggcagggagaggagccgctcctccgggtggtccagggcccggagcttggacagccccaccgtggccgccacatgccggttcatggcggcggcgtggccgccggccacatcgctggccacgcagcagcgcagcccctccgacaggctgcggcgcaggggcatgacgccgctggacaggttagtgttggactgggcgcagtgggccagggtgaccccctcctcccggagaatagcctcctcccgcccggtgaggtggacggcgtgggccatgatggtgcacccccggcggagcaggccgtagtcccggtacacctcggtgtagctggcgcactccggatggagctggcccacccaggcgatctcgctccggttctccgacaggtgggactggacgggcagcccgtaccgctcccccagccgccccaggccgtccatgagccgggcggtggtggaggggacgaagcggggggtcaggatataccccacgtgcttcagctccgcccggctgcggcagatgagctcctccgtgtccgccagggaggcgtcggtgtcctcccgcagactgtccggggcattgcggtccatgttcaccttgccgatgagggcggacagccccgcccgctcggtcagctccatcagccgccaggcggcctccttgtggatggtggcaaaggcggaaaagcgcagggtgccgttggcccacatccggttgaggaaccgcttccacgccgcctcggcaaagtccgcgtcgccgtagcgggcctccaccgggaaggtgtaggtctccagccagggcagcagctcctggtcgtagcccacgccccggttcaccatctggggggcgtggaggtggaggtcgcagaaggcggggagcaccagcgcccggccgaagtcggtcaccgactgcccggcgtactcctgggggagcgcccggtaaaagccggcgcacttctccccatctaccaccaggtactccccctcccgcacggtcagctcgcccagcgcgggagtgtataaaaagttgcccttgaaaatcatggcagaccctccggttttcatattcttcctttatcctatcatccacccctgtagaaagcaatcagaagttttcgccccggcacagaaaagccgacgcacccgttgcgtgcggcggcccagcctgtcgaaaaagacttttcaacaggctaccggactttttgaagctctaaaggagcttcaaaaagtcgtttaatcaaacgtgaaagggaaccctgacggttccctttcacactatccttccctccgaagcctttggcaggagggtttattggtagcctcaaccgccgcacccgttgcgtgcggcggcccatatcttttattcgggtattcagggtaccagctctacggtgtagcccagctccttcaggccggacacaatgccgcccggattcaccatgtggcccgcgcccacggccaggaagaacgtattctccccctcggtctccagatactccgccgctgcggcaatcatgccggggtcccgctcggtgaacagcttggagttgagctcgtcatcactgttgaggatggcctctttgtcgtagacctccgccagggcatcggggtcccggttcttccaggcgtcgaacatggcggcaatctgctcctgctgggcctgggccagcgcctgggccgcctcgtcggccgcctcgccgttgagcatcccctcgtacccggccaggctggcgtccagataggcctcctggtactcggcggacaggccgtcgaagatgccgccctggaaggcgtaggtctccacggagtcgatggtcttgcccgcgttcaccgcgtaggcgttgatatacacatcaatcgccatggcgttggccccggtggtgtcgtcctggaggctcaggacgccgaaggtggaggccagggcccagggcttatatgcgtcaaagccgttgggctccatgcccaggctcaccgccgccgcctgcacccgtgcgtacagctccgggctgatgtggtcggccagggtggtgccgtcggagtaggcctggagctgggccagcagggccatgccctcctggtcgttgagatccagctcgaagctcaccacctgggaggcgtccagggcgtcccgcaccgacttatgcaggggatagacgttgctgcggtccatgtggatggtgcccagcaggtagagggtgttgtccccgttgacggccttccacagcagacctctggagccggcgtcgttggcgtcatagagggccaggatcagccgctcggccataaccatggcctcctgataggtgcagggccggtcctcgttcagtccgccggcctgatcgcccctgaccacgcccaggccggtgaggaaggccgcggccccctcctccacgccgtcgatgtcgtaggcggccgcctcctggtacagcgcgttcatcacgccgccgcgggtggtgtccaccaccagtccttcggtgtccgccgcccgctggggcagctccagcagggccagcttgtcggccacgatgccggtcatggccgagagctgctcgctggtgatggtgctctgaatgtacgtagtgtagttgtcgtccaccagccccatggcgtagctgtccgccagctctcccaccgcccaggcgtcgggcatctgaggggccggagcggtatcttccgccgccagcgcgggcgcggccagcagggccgccgccgtgacgccggccagtagccggcgcatccgattgtgcttcatgtcatgtgctcctctcgtcgaattgtaaagcttgctttccacatgtactgtaccacagcccggccccgccgtcaaccgcaatttgcggcagtgagggtctgcctctgctatacacgcagttatactagttctatactagtaatatctatgttttagcatgtaataatctatctgtcaagatgatacccttacataagggtgagacgcaatgaaaaaagaggagcacaacgcccggtttcgggatcactatatcgccatcggcatccgcatctcctacttccgaaagctacgggggctgagccaggagcagttggccgagcgcgcaggaatcagccccggctttctctcccaggtggaggcccccggcatggcagtgggcatttccctgagcacccttttcctcatcgcggaagcgctggagattccgccctacaagctgctgcaatttgacgattgacccgcttcaaaccgcgcaggccgccccatggggcggcctgttttctatatctgccctctccgcacgctcaggctggcgataaactgcttggcggttcgcggcgtccggcccgggctgcgcatctcaccccacgggaggttccctcccgtgagggccccttttttccattcggttgaggcgaagtcaattcgcctcaaccaaggttttgcctccggcaaaacgcttgtacgccgcggggcggcggggcgcttccacgcccgtgggagatgcgggcacccggtcacaggctcaggctggcaataaactgtttcgccgttcgcggcgtccggcccgggttgcgcatctcaccccacgggaggttccctcccgcgggggccccctttttccattctcttgaggcgaagtcaattcgcctcaaccaaggttttgcctccggcaaaacgcttgtgcgccgcggggcggcggggcgcttccgcgcccgtgggagatgcgggcacccggtcacaggctcaggctggcgataaactgcttggcggttcgcggcgtccggcccgggttgcgcatctcccacttgaccgcctcggcacgaagactatcccggtccagcgtgatccccgcctgctccgccatcccctccaccagctccaggaactccgcctggttcagcgccaagtagggtatgcgcaggccgaagcggtcggacagggaggtcttctcctgaatggtctcactggcgtccacctcgtcccccgcccggtcagagaaggtctgccgcaccagccgccggcggttggaggtggcatagactgccacgttggcgggccgccgctctaagccgccctccaggatggtcttgagggcggagtaggtcttgtcgtcctgatcaaaggccagatcgtcgatgaacaggatgaatttcagccgccgcccgcccagggtacggatgagccggggcagatcagccagcccctccttctgcacctcgatgaggcgcagggcctcaaagccgggcagggtgagcaggttcttcaccgtggcggacttgccggtgccgctgtcgccatacaggagtacattgttcaccaggttgccctccagcatggccctggtattggcgatgacccggttccgctggagctcatagcccagcatctcgtccgcgccgggacagtcgggttgctccaccgggcagagcgccccatcttcccacaggaaagcccggtgccgggcaaagagccccgcgccgttggcccggtagaactccgtcagctccgcaaaagaaaacgggctgctcccccgccaccggggcaggttggccagcaccggcccatactcccgcggcgctttcccccctacctcagcgagcacctggtcccagtccagctccgccagcagggtgaacgtctcaatatcccgccgggcggccgcctccagggcggggtcctccccgccccgctccaccagagcggcatagggggattcccgatcccggagccggccgtccagccactcccccaggctccggctccccgcgctccgcagggcatagaacagccgggcgtagtcctccacggccccgctgccgtccccggcggacagcttatccagtacccccagcgccaggcgcatcactggctcatccacaacaggccggtaggccgctaccccccgcagggcgcagcgcagcatgtcggttgtcattttcctctcccctctcgcgtttgttctatctgtgtcggttttattgtaagcgcctcccctccggctgtcaatgtccgcgttttctttccaaatgaaaccactggctgcgccgcataggcaaaagaaacctgcggataataagggctgtaactacaaccgcaggaggagtttatagatgaaagcgactggtatcgtgcgccgtatcgacgaatgagatataatagggcaaagtcggaaaccactatgaatggctgttttttcgctgattttgtccaaatttcagaacatattcgccatatttgttggctccgacatttcgatactccataaaaaaggggggcagtcatgtcggagcgagctggaaacgctcactccaggcataacgccgagggtgggcgtttcctattccgggtttaattctcacgaaagaaagagggtacatagaatggcgattattttggcgatcacaaactccaaaggtggtgtcggtaaaaccacaacttgcgctaacctcggggccgccttgtccgcagcaggaaaggccgttcttctggtagacaatgatccccaaggcgatctgacaaaagtaatgcgctctgaccctaaatcattgaaatacacgcttgcaaatctgatgaatgcagtgctggatgataccgagcctgaactctttgtaaatagggcggtcattgagggggctggcattcactacatcccggcaaattccaaactggctggtgtgtccagccggctggtcgctctgcaaatgagcagccgttaccgcggcggagagaccggcggtactccctgtgagctggttatggctcgtgtcctggagcttttccagtcgcagtatgactacatcttaattgactgtggtcacagtatggatctgctgaccatcaatgcgctggctgcggcccatcaagccattgtccccgtgcaggcccactacttggctatggaagacatggctgataccttggaggtcattcagacaatccgccaagggattaaccccaaattagctgtcggtggtattttgctgacgatgtaccaagggcgtaccaatctgtgccggggcatacaggacgagatccaagccgactacggcaacgcatttaccgtattttcctcccccattgatttctcaatccgtgttgcagaacatcccattggagcggccagtatctttgcatacgagccgaacaaccccgctgcaaaggcttactccgccgtcgcacaagaggtgctatcctatggccagaaataaagtgcaggacgcactccggcaacggaaacgaagtgaagcggaggcggcgatggcaaatggcccgccggaggagggagcctaccaatgctttttcaatcgcgatgatctcccctctcctatggagggtggaacgctttgtgattttccgctggcccagttgagtggttttcccgaccacgaggagcatttccctctctataccggagcgcggctggaggacatggtggagagcatcaggcggcatggagttcagtctcccattctggtctggaaaactgctgagggcacctatattataattagcggccacaatcgggtcaatgcctcaaagattgctggattgactacaatcccagccgttatccggacagacttaactcaggaaaccgcggaagacctgttctatgagatgaacttccggcagcggtccctcgcggatatgctgttttctcagagagtcctttgcattgcggcccactacaatatgctcaagcgccaggggcgccgcacggatctccagacttttgaaacaacttctcctgacactcaggaaaagtcccatacggatgtaaaaatcgcacaggagtatgaactgaccagggataaggtatccaagtattgccgctatgctacattataccgtccgctgcttctgctgatgaatagcggaaaacgactgggacaactggctgcgtatgaaatcagcttcgtggaggaccatagccttcaggagtgcatctatcagtttatttcggaagggagtgcctctatttccacggcaaaagggaaaaagctccgcgccgcttttgaagacggcaaactggatgcctcccagatcaaatccatattgagcggaggcggcttgtctacctcaaagcaaccggggcggcgcgtttctgtcacgctccctccggcctttgcaccgtacttcccgcccaaggccaccacaaagcaaatcgaagaaaccatacaaaaagccctggctctgtatttcaagaccatgggaaatgcttcatagtccagtaaagcaaataggctcggcacccctatcgaccgggagtgccgggtctttctttttactttttacaggaggcggttgccaatgtcaaagaatctttatctctgtgtccccgacccatttgatagttcgaccggtgcgcggctggagcgtatgggaattctgcgcccggatggcgaggtaaatgttgaagtaatgcgggcttttgtgcagatcttcggcggcttattttttgatgatctgtgcgatttctactccgatcaaggagaggtgtctgctgtgacggcagctttttcagagttggccgcccgcaaagattgtcagaacatttatctgctgatctcccttcagtatgataccattcggaaaccgctccctgatcccatctggtggctggccggctgcgcaccagccctgtcgctgttttgtctgggttttgtagaacggcttctggaactgtcggaaaatcaggccagcaacgggaaggagatggttgccaatgaaactgctgattgctgtaccggctgaggggagcgttccccttttggagttctttgggttgctggatgaaaagcaacggcaaaagctgctttcgctttttgcccttctcctacaatctccagcggcagtcatgcgcgagccctatgtcaagcacttctgcatcgagcgttaccaggcgctctatgaactgcgagccaagagcaaaaacctggtccgcatcattttcacactcactgatgacggggacatcctgtttctcacgccgtttatcaagcgtcataagcggaacaccatgcaggcgctggaccgctccctggactgtttgacgcacatcagagatggatcatgctctacgcaagagctgtccataaaattctttctcaacggaggtatcacagtatgacgaaacacaaattcatttgggctgggcttgccatcggagtccccgcactggtcctggcgctctggaaaggctggtggtgtaaggtatgaaaaaagtggcaatcctgctggcgcttttttgtatgctgacggtcactgcctccgccgcctatattcccgaggatgtaatatccgaaaatcgggatggccgacagctcatcgtcaaaacctatatgcttccccctgatgcagaccccagcggtctggtagaggagcctttcgaggtggagggctattcctaccaccatcttgaaacggtcaaagaggaacagacattcgaggattctaaaatccaaacggaggtcgtcacgctggaaacagatgtagatgatcttgcggctattctggaacagctggatgccagcatggagtacaacaaggatggctattccggagtgctgactctggaccacactacaatccaaaccgaagccgcaggctataccactaaatactatacgattaccgataccaagcagtttacaggcctggaccgaaacgatccctcctatgtccctactactactgtcaaaaacggaagcaccttgaagctgagtgacatttcctggaccgtgacagggaccggcctggccgatgatacgctggttcccacttcatacacggctacggcaacttataccgctacggggagcagaagtgtagctaccggatatgtgacaacggccagctataccggcgaaataaaggccgagggtgttgaagcagtcaagtacaccgtgacctaccttggaagtccggtgggattcctggctggcctcaatcccatgtggctcctcgccgggggagggcttttgctgcttgcaggtaccgggggcattatttatatcatgaaacggccccgcgcagtaatttatgctatgaacgcccgaggcgtcgcctataagaaattgggcaagcagaagatttccacccgcacccctaagctggatctgacgaagctccgggaatacccggctggagacgcaagcgtggagcttcccagcaagctggcccataagctcgccggcaggatcatcactatccagatgtatggcgggagccgcacccatctggtggaggcctacgacgggcaggacagttactggtttgccatcaaggaggatgcggaggaaaaggaggaaagtgaatcgtgaaaaggctcaggggactttgcctgtccctggcggggctcatgctgatgactacgccggcccttgctgcggactacaactttgaaacaccggcgcccaaggacttctatgggagcacttcctacgaagaggtctacggggctcagtataactacggtggcacaaacgcggtggactttcttgatcccctggccgacagcgcccccgggatctccatcaacagcggctcttcactggaatacgggatcaattcaggaagtgggagcatttaccccgatagttccggaagcagctaccccatccagtggggagatgttcccacgcttccagcgacccagttcacagcggtgagcgaagtagagcggaacgatggcagcattggtactctggtaatccccagcctgggaattcgctataaggcttatgacggtactgattctgcttccatgcgcaaaggtgtgggccacttccccagcacaagcgcctgggagggaaacatcggtctgtgcggacacaaccggggctccagccacaacatcggcgcaatcaaggatctggaaattggcgataccattcggtatcagaccagcctggggacaaggacctatgcggtgagttcggtcaagatcatagactggactgactggagctatttgaacagcacctcagacaaccggatcacgattatcacctgcttggccaatcagcctaccaaacgggtttgtgttcaggggatcgaaataagttcataaaatttttatcgaatatttccttggcgctttcattgggaattatgtgaaaatagcaaaatcgcagaacatatttattgactttcgttttatcggtaaaggcgtttcaaaaaaacctttgacaagtcccgattttcgccttattttggtcttgtaaggacgctccaacgagaaaaggggggattgtcatggttaaggagtttccgaaaggaaaagagtggctgctggacaattccgcgctccgggtcagtctggacatgacctttgatgtccctgaagagattgcggagcagttagaattgtggggtcttaatatctttgaaacttgcgaatatgatcccacatgccggcggctaaaaatgagcgccagcacgacgctatatcgaaagggggcataatggaatgaaacaaaaacgccttttaccgttgttcctttgtctgtgcctgctgtttgtactgccggttaaggtaagcgccgcagacaacagcgagcaggaaacctccgcagcctatctccgtgagcaggggatcatggtcggtgacggcaatggcgagatgaacctggactctggactgacccgggcccagctggccacagtcctgacccgcctgcatggaaacccagagcatgtgcaggtcgatcaggcattctataccggacaatgtaaattcccggatgtgccggagtgggccaggctctatgttggttactgctatgccaacggcctgatggtcggctatgataccggggcctttggcgccgacgatggagtgacacctgcggtcgcctgcactgttgttctgagatatatggacctgccggacaccgaatgggactactctaccgcctgccagacggcattggactttgggctgacttcggtggaagttgctgttaaagccgaagtcacccgcggtgatttggcggtcatgctctaccgggcactgggtaatactgatgcctccagcgagcatcagggggaaaccctgagcaggaatgcagacggctccatcaacccgcccgccgacggctctcagtatatccctcaagtgggcgatgtgatccgctgcgatgacggcaccaactataccatcactgatgtaagccggtgggacaagaacatgtttgcctccggcccaatcggtcccttgccggagccaacctgtgactggagcttgctcgaacagccagaattaccgaaagtggaggtgagacatttccaaaaccagactggcgatcatctccgtatcctcaatctctatgaaaccaggcggatgctttacacactttacaatgctattggggatagctcaaccacctgggaaaatggagcgcccaaactcacctcaaaaggaaaccaactcgttcacatcaaccttggcttttcagaagatctcgcgtaccaaatgttctggccctggcgagaaagtgagattataaaggtgtttaatggaatacctggtacctattctatgcaggcctgggatgtctacaaggacggtcaattcctacacaccgaataccagattcgtataaactgatttggaaagaaaggcagcgtgccactcggcacactgtctttctttttgcccattttgcattccctacaattcaatcaagcccaatcaaggggggatgcacctatgggtaggggcgtcctcccgatttttatggaggtcgctcatgaaaaaaagactgatttcgatgctcctggctctccttgcggtcatggggctcctgccaaccgccgcttttgctgcgtccaccccagaggaagccttgggggaagttcagatttacaatggcggggttgaaatgtcttatctgtccatcaatgggcggatcagatcccaaatttacacctattacaattatgataacgggagcgggagcactcgggagattcccgcttactgtgtcaacccgaacacgctgggggtccctcagaccgtgggagtcggtgagagtattgaatatctcgccgatgaaaaagccagcgatcccaaggttgtcggtatcgtggccaacggctatcccacgcgaagcctggccgagctgggactggaaaacaaatatcagggctactacgcaactaaaatggccctgtggtgttatcttctcagcaactgggacatcaacaacctcaaggtcaatcccaacctgaccggcgtagaacttcaaagagcacagaagattttggctgcggcaaaggacgtttacgcccgtggtacggcctggaatgaaatgctctcccctgaagtgacctgtaccccagaccgggataccgcctatgaggtcaccattgacggaaagcagtacaagcaacaggtctttactttctggtctaaaacctgggtatgcgattactccgtcaatgtcgcgttttctgtgccggacgatgtacctgatgggacccgcatcgtggacatgaataatcaggatattaccacgatcaccactgagggtacaggcgacggctatgccggcaaattcaaaatcctatatcctctggaaagtgtgcagggcaagaccggcagcgtccagttgtctttcaacacaaatgtctataagtacgctgtattttttgcgatatgtcaagagaaagatgaatatggcgaactccagaattatgtggtagatactgaccccactacaacaatgcagttgtccgcatacagcaactactcggacggtacgaccatcgagtatgaaaccggattgcgcatcatcaagtatgagaccggcaccgagattccaattagtggggcactgttcgaggtcatcggccccgacggtgattccgtaggtacttttgtgaccaacggggacggccgcatcgaaattccgcttaaaaagagcgggaattataccgtagttgaacgggaagctccacagcattatatgatcagcgaggagcctgcccagaatgtcaccgtcgtctacgatgaagtagccgaggtgacattttttaatgacccctacggtactctgcgtattgagaaaaaatccaataccggcatgaacctgccgggggcagtcatcacagtcgagcatattgagtcgggacagacctttaccgctacgacatcaagtgcaggcgttgctattttcgatgcgattcccttgggcgcataccggattcaggagaagactgctccggtgggctggcagttggatgataccgtctacaccgccacggtggtggccggtgagaccaccacaatccctatcatcaacgaggagttaccgggattgcggatcatcaaatatgatcgaaaaaatatggtcgccatgcccaatgtcactttcgctgtttatcgggatggcgaatttttaggcaatttcaagacggatcaatttggtgaaatcttgattgccgatgcagagccaggtacttaccgggcgtttgaggtagataccggcgatgaggggcacattctggacaccaccccccaggaggtagagctccacgctggagacggcattaaagagctgatgtttttcaacgacatgaagccgggattaaagctcatcaaggtggattccgacgatccctccaaggtaatccccaacgctgtattcgagatcaaatcggtggaggggacctatggcccccaggagttccggactgaccagagcggagaaatcgacctgtctatgctccctgccggctcctatgtggtaactgaaaaatcctgtgatggctacatcatcgatgaggcccagcgcatcattgagctgaagccaaatgaagacgcccaattcgtttttaccaaccatgtcaagccctccctccagcttatcaaactgagcagcgatggctcccggctggccggggtgactttccgcatcgccaggattgaggacggcagccactacctggaccgcaccaccaattccaatggcgagatcctgatttccgatctggagcctggcgtttattccgtccgcgaattgtcctctgtgcaggaccacatcccggacgataccgagcaccatgtagaactgttcccgggccagaccagtacgatcactctgaccaacgacaagcgccccaacctctatatccataaaaccgacgccgacaccggggagcctattgagcatacggtctatttggtgaaaggtgcggacggccactctatcgcggaagtggagacggacgggaacggcgtcgccgtggtggagaacttgctgcccggcgtcgtggagatcatcgaaaagtcggtcccggagccctacctgctggccgaggagtctcagatggtgacgctgctccccaaccgggatcgggatgtctatttccaaaattataagcgcccgaccatcgagatcatcaaggaaaattccatcacacatgatcgaatcgaaaatgtgccgttccaggtctggtatgcctccaacaacaccgctaccggagagtacaacgacctgggcgttttctacaccgatgaagagggccgtatcgtgctctccgacccggacctctctcttcgtgacggttggtttcgggtaaaggagctggagcctgcaccgggctttgctctggcggacccggacacacaggaggcctttatcgccgctggtgagggccatacattccgcttcctcaacagaccgctctcagctatttccgtatggaaatatgacagtgagaccggggccgctattgagggggctgtgttccaggtccggtatctctccggcaacacctccggcaccggcggcacggtcatcggcacttaccgaacttcggtgaacggctctttcaccgtcacgggctgcaaggccggcacttacattatcgaagagctctccagtgacggctctcatgtgatcgacaccccgccccaaacagtgtacctctccggcaaagatcaggaggttgttcaggtctattttaacaacagccccaagggctcgctgcttatcaaaaaggtgtccagtgccgacaattccccgatttctgatgttcagttctttgtgactgagagcgacgggaccgtggtgggcgacagcaacggctacttcgtgaccgattccgcggggaccatcctcattgagggcatcgaccctggcaccacactcgtggtcaaagaaacccgggcgaaagatggtttcatcctggatgacacaccccagacggcccaaatccaagccgggcaaacggttaccctcgaatttcgcaatcaacccacaggacaactcattatccacaaactctctggcaatgacaagaaaacgccgcttgaaggggtacaattcaaaatcacatactctgacggaagttttgtggatgccgacagcgggcagctctccagcaatggcctgtactggaccaactcggaaggtcagattattctttccggcctcacaggcacagtggtggtaacggaggtggaaagcatcccgggctatacgattgaccccaatacgcagtcccaaaccgtggtgatcaatcccaatgacacgcaggagctgtatttttacaacaatcccataggcggaattgaaattatcaaggtcaacgcgagcaagacctccgaaagaattcccgataccacttttgagatccgccgcatggatgatgccttggtagataccatcactaccgataaaaacggcagggcctaccttgccctggaggacggctcttattacgcgattgagatcgaggccaacccggatttcgtgctggacgacaccccgcactattttgaagttaaagacgggaaagtgaccactctgcgggtcaccaacgccgccgcatctggaatcctgatccacaaggtggataccagcggagaaggtatctatggcgtcaagttcttactctacgacgaggaccgcaatcccatcggtgagttcaccagcgacgatgacggctatgtttatatcaccgctgatgatctcccggatggtgccaataccagcggacgcttttatctgagagagctggaggcggccgagggctacatcttggataaggaatataagaccgtctatgtgcgtccgggccgcacggcggaaattgagtgggtcaacgaagccatcacaggtcaaattcagatctacaaatacgccgccgaagcaaactccgtcacaggcgttccggccgggactcccctccagggagcagtctatgaaatcatcaatgagcgcagcggccgggtggtggactatatcactaccgatgcccggggtgttgcggcctccaaacccctgcctttgacacgctataaaatccgggaagtcaccgcgcctgcctatttccagcttgatcctaccgtccacgatgtcacactggagtatgcggggcagatcatcaaaatcgcggcctatgacaagccggccaatctgaaggtcactgtcaccaagaccggcaacaagcaacttctggccggagattccatgcgctatgaccttaccgtggcgaacaattccaatgtgccgctggagaacttctacctccacgaccgcttccccaccgactgcgccacagccaagaccatcacaaccggcacctataacacccgtctcaactaccagatcacctataagaccaattacaatgactaccgggtgcttgctaccaacctgctcagcaccaacaattatgcctttgacctttccgccatctcgctgatgcaggacgaggtggtcacggatgtgcgtctggagttcggcaaggtgccggctggctttgcttctgtggtaaagcctaccgttaccacccagaccagcgccaaccttgccaatggctatcaggtggtcaaccgggccgacgcgggtggccaatatatgagccagtgggagaccggacgcgccgcatggatcaccctgatcgtcaagctcaatcagcccaatctccccaaaaccggctattgacatgatggataggggcggcattctgtgtgccgtccctatcccctgaacggaggtaaacagatgacctattcttcctacctgaatgataaagaactccgtgcggctgcggatcgttatacggagatgtatggaggacaatttgaatgtgccgatacaggagatgtcctcctttatcggaagaacgaaggagacacatatatttcggtgaaagctgattatccggtcccgctttttaccaagcggcttcggcaggccaccatgcacaaatacacagtcaatttactgacgctctggtggatgcctattgatgaacaggacctgcaagatattcccggcttctatcgaaggctgttccaagagagtgagtgcagcccggcctcgggcttcgcaatggagtctcccctaagccggacgcctaaataatcaaaaacaaccgtcaatcatggactgtgtgggcaattacctcgggaacgagggcgcttacacagtccctttttatgctccgaggagggatgccctatgaaaaatcttctggtccgtctcgtgcctaaagccccccgctattatgttcagataatggcgtttattttgattgtgacctatatgattacgccagctctggccgtagaggatatgtggacggccgcaaaccgtatcatcgtcgatgtctataacaagattgccgggatcagcaccgtgctggccggcctgatgtctgccgttgctgtgattggagccaaagtttccaataaccagcataaaaccgatcaggcatgggactggctcaagcgtatctggatcgcttgggccatcattaacggaatgggcgccttcctggcctatgtccggcctctttttgacggcctggccaccattcagtaaacctctcagccatacgccggttgggaggtggtttttattcttgaaggaatttttaagggctttgttcagtgggtttacagcctgtgccttgagatggtccagtatatcgcaaattctcttctggaagtttttcagatggatctcagctatttccgtcaggtggctccggtcacagacgatattttgagtatcgtgattgccgttgggtgggcgctgcttctgggcaatctggtctttcaagcgatgaagagcatggtcatcggtttgggctttgaaggtgaggaccccaaactgctgtttacccggactttcgtgtttgcctttttgcttctggtgagtcagcaaatttgtgaaatcggcctcggcatctcatcgcaggtgattgcgttgcttcaggttcccaccagcgtcaccattaccatcccggatgaaaataattttacgattggagcttcttggctcctgatcatcattgttggcattgtcgtgatgtggcagtttgtcaagctgtgcttcgaggtggcggaacggtatgtcgtaacggctattctcgttctcatggccccgcttgcctttggcatgggcgggtccaaaaatacggaggacattttcaagggctggtgccggatgttcggctccatgtgcgtgatgatgattatgaatgtcatattcctgaagctgctgatttcggctttggggtatgtaccaagcggggttgccgtcctgccctggatgcttctgatcgtaggtatcgccagggttgcccgcaagatagacggcatcatcgcccgcatggggcttaaccccgccctcaccggcgatgggctcggccgcgggcttccaggcatggtggcttatgcggttgtcaaggggatcggaagctccatcgcaaaagccgccggaaattccgttggaaataaaagtcggaaaggcggcagttccggcggaagctcttcggagccgcgtaccaatccgcgcacacccccgccgcctccgtctggcggaagtcctggcggcgctggcgcctcgcctggagctgccagcgcaggacaacaggcaggaacacagacggacccccgttctccttctgctcaaggcggagtgtatgcttccaaacagactgtgcagggcgtctcccccaagatggatgaagccccgccagagggcagccatgcagcgggggttgaacaaccggccgctgaacacaagggcggtaagacgccgacgatccatacacatggggcacgacgcagttctgttcccccggaggcaagggggacccgtgcctctactccctataccgccgcctctgtccggacaggcggggtgagcggcgagtcctccaaggggacgctgggccgcactgccggaccccaggatgggacgcgccggccgcccggcactccctcgtatgaccagggagacagtaagcggcccgatagagcaggcgtaacccgcaggtcggccgtaacgcctgggacggctgccgtggccggtcctgaacgcacgacgcacacctccagcactcgtgaaaccatgcgggagcgcccgccgcttcagcaggaccggactccgaagatcccgacgcctcctggtgtcgctggaggtgaaaaatcagagccccgcccgccggttgctccggcaggaactgcttctcacggtgcagataccgtgtctcgtgtaggcggtagcgcatctgctacaacggagaaatccgcggcccgtcccccggttgggagtcagaggccgcgtgagggcggcgcttccacccccggaacggcaggaacacggccgcctattggtggtcgtcaatctcacggtggtgaagtatcttcctccagtatggcaggaacgggcactcccgccgggagcagtaccgtgtctggagtggtatcacctttcgtcggtatggcaggaaggcataccgcctcccccatcccccatgcctccccgggcggcgaaggtgttttgtcggatatggcaggaagtccccgccccacagcaggcagctcccggagcagccgtgccgcgcccccgcccggaacagcaggaacggtatccgctgccgggcatgaggcacattccgttacaagcggcgcttctccgtccggaacggcaggaacgcgcaggcccggcgggactgggaggactccggcaaaggcgcagacgcctcccgccgcaacggcagggacggctccgcaaagagccgacgcccctccaggtgtaaaccacggcaccaggcgtatgaaaggcgctatgccgccgacaccgggcggaacgggaaagtctccaaaaaccaggaagaaaaggagtgagccatgagcaatcaatcttcggcgggccagaaagcggcccgggcggcttccgccgctgtaaatattgcacggggagcggccgcaggcggcgtctatggcgccgccgtggaggccgccaaatcatttttgccggagctgatccggcttttcgtcatcctcctgtgcgttgtgcttctggttcctatgctcgttttcacagcacttcccaacattcttttcggctactccagctctaccgaccaggaaatcatcgacttcaccgcgtctgctcaggagcttgacgggatatatcaaaatctggacaattaccagcagcctgcggttttgcgcctggtgaacagtattctcccgcgcttctggtccgatggagagcctttgtatgatgattatggcgtggatcaggacctggggtacatgaacaaatactggctgatggcgattggctcagtccggtataaacaagacctttacactatggatgaaagcgccattgaggacatgatgtatgaccgcctgacctactctacctctctgatcgaccgcatcctgaacatctttgtccgtgatttgacgcccgaggagtacatggacaagctgaattttacccaggaggagcgggactgggcggcgctgctctattccatgctggcggaggatcaaaacctgtcctacggggacagcgacggtgacggctactacaacacggactacggcgacatcaccttttctgacgcggaaacaccggtcgtctactataatcagacggattcccgctggggaaataagatgtacggcaagtccggcaccatcggggaggccggctgcggtcccaccgccctggcgattgccgtggcctcgctgacaagcaatcaggtgacgccctacgatgtggcccagtggtctgtggaaaatgggtaccgctgtgagggaaacggaagctaccacagcctgattccaaatgggggcgcgcattatgggctgaccgttaccggggtcgggaacgacagtaaaagactggtggatgcgctcaagaatggaaagctcgtgatcgccattatgtccaagggtcatttcaccagctccggccattttatcgttctccggggcgtgaccgagggtggaaagatcctggtggcagatccggccagcgtaaaacggagcaatcaggaatgggagcttggaatcatcctcaatgaggcgtcccgccgcgctggctcaggaggccctttctgggtcatgtccgcttaggtggctcttatggcagaacaaaatatgtgccgaatgacacagctccgtctgcgttacggtatttctcaggcagacctggcaaatgcggccggtgtttccagacagctgatcagcctgattgaacttgacacggccagtcagagcaagggccatgaggccttgatccggcgggccttttccgctgtcatcgcttcccggcgggcggcgcttgacgggctggcgcacgagttagatgctgccccgtggctattttcgatgtccaaggaggacgacgagcatggattctgaaacctattacatcccagtcaactataccgatgcgggaaagctgttcgggctcttcgagatccgaaacgcaatcgagtcggttgtcctgggcctgccggtcctgggtctttgcaccgcgctgctgccttttacgatcacatggaagatcattgtgacgctgtgcctgctggtgccgaccgtgggatttgcgctgattggcctgaaggacgacagcttgacccgttatttgaaaacctggtggacctggcgtcggcggcgccgggtcctgacctatcgtggagaggtgaatgcccatgaatttgaaaaacgctatcttcggtggttccgtcacgggaatcagtgaccgcagcggagcctatgacgggagcatccaggcctggctccccatcaaggatattgtccagggggtcgtcgtcacccgggacaaacgctttgtcaagatattagagctacttcccgtcaacttctacaccatgtccagcatggataagagcgccgccatagaggactttgccgcctatctgaaaatcgcgccagccaatcttcaaatcaatgtcctgacccagccctttgacctggatggctacctaaagctgctcaggggctatctggagcgggagaccaatgaacagtgccgcttgatgctggaggagagcatggactatgttcctcagctggtggagcgggaagctcttacccaccgctttttcctgtccttttcctatgacccgtccatgaaggccccggatcacacaccggaggccattgccgcggtgctcaacgaaaaggcggaggtagcccggagatatttggaccggtgcggagtggctgttttagagccggaatatgcggacaattttattttggaactgttctacaagctcatcaataaacacacctcccagcatcttcgtctcccggacggggtattcgatatgctggggatggtacatggcgtctacgatgaagaagcactgaaggcgctggacacggcggccgcggaaagcgccgggaaaaagaaacggaaatggttttcccgaaaggaggcatccccgctctcccgtctggaggccggagccaccaccattccggatctgatcgcgccgcccgacatagatacgcaccatcccgattatctgctgatcgacggggtatgccacgcctatctctacatcagcggctatggctactcgaccgttgtaggcaaaggctggctcacccccctgattgaagccggggagggagtcagcctgagtttttacttggtcaaacagccccgggaaaagacggtcaacgccatcggccagacaaccatgatcaaccgctcccggatgagggatgtgggtgatacccgtcaggattttgaggaactgggggacgccatcggcgccggactgtacctgaaggagggaatgaacagagaaggccaggatttttactatatgcacaccttgattgaggtcatcgcagacgacccggacaccctggagcagcgggtaacggcggtagagaccctgtgcgtagcctccgatatgctggccaagcggtgcgagtacaagcatgaggcggcattcttgtcgtttcttccgctgttgatctcagacccggatattgaacggaaaagccgccggaacgccttgacctccggtgtggccgcctcgtttccctttgcttcctttgagctgagcgaccaaaagggtatctttctgggcctaaacctctacaaccgctctccggtattcatcgacttgtacgatgactacaaatacaccaacggcaactttgccgcgttcggcaacagcggagcgggcaagtccaccctgcttcagagcatcggcaagcggcttcgggagcagcagcggaaggtgatctacattgtccccgaaaagggccatgagtaccgtcccctgtgcgaggcggtgggcggccagtttatcaagctggggccgtcctccccagattgtatcggcctgatggacattcgccgtctgaaagcctctccctacgcggctcagaatggcggtacccagcgccgggagtccctgctggcggagaaagtctcctggctctccgtatggtattctctccagaagcgcaatttgtcggaggaggacatgaactacatcgacgcctctctgattgagtgctacggccgccgggggatcacctttgacaatgccagcctgtttgaggaggacggcgtgaccatcaaggagatgcccgttatccaggagtggtacgacatcctgcgggagaagcaggaaaccaagcacctgtcagtaatcctgacccgctatgtatccgggtcggccgcctccatgggtgggcataccaatgtggacacggaaaacccctacattgtgatcgacctgactgatattcccgatgaccttcagttggcgactgtgtacgcggccaccggctttgctaccgacatcaccgtgcagaatggggatgtgggaacggccctgctctccgacgagctgtggaagctcctgggggcgaactccaatcctctggccgccgactacaccatgcgcatggtaaagttgatccgctctcaaggaggggttgcgggcgtcacatcccagggcatggccgatatgatggcgctggacggaggcaagtatgggaaaggtattttggacagctgccggatcaaattcatcatgcagatggaagatcaagaggcaaggctggtgcagaacatcctcaatctgaccgaggaggagacgaagatgattacccgcttccgccggggggaaggtctgctctgtattggtcataaccatgtccccatcgccgtccatgtgtcccccagggaatatgaggccattaccacctcgcccactgacctgcgagcaaggcaacaagcaagggtggaatagttctctcatggcaagaaaatgccggtaaaacgatagcgttttaccggcatttctctactgctttaagtgctcccttgctcgttcagccaattctccataagctgttcctttttcaaatactgctgaacaagggcggaaaagtcgttgtcaagttcagctttaagataagagcggattctatgatcgagcgtttctttatccatcttggcttgaccaaaattgagcccgaccaaaaattcccgcgccccatagctgccgacggagaaaaacaactccaggaagtaatagtcatcctgtttgcggaaatcggggtttttactacactcggcgtataagtaaatgcgctcctcaaacgctttggaggatagtgaaaaatgggtggaatagaattcatcgtctatgatgtcgatagtgtatggctcgttcatatcgtatcccctgttcgcatttattccctaatgtaattttactgctcatattatactcattttcctaagaaagtaaaggagatggcatcaatgcttgagaaaaaagatcatgtaaagcggatacaagaaatcacctttgaagcctacaaatccagcggccggatcgccgcgcttctggaccagaatacaggcccctcggaacagttgtctgaggaactggagcgggtggcagctcaaatagagcatggggcgatagaactccgcaacctttgcgcccgctatcaggcgccgcttcctccggtagggcaaaagcccgcgctggagccgttgaacatcgccggccgtgcggagtgtaacgaatttggctggcttcatatccaactgaacgcgctgcttcccaactgccgctttgcaagccccctgtggatcacagacaccataaccaggctcctggaccgactggagcggcgaaacggcaagctgcctcttttggaggaggccctgctgatgatcgacgaacactgcgacatcgccgcccggcaggtctacgaccaggataataaagcgtggaaggcaatctcaaacgcgctcaagggccgggtcgtcgctgacgatgaccagtacagcctgggggtatgcctgctgtccagacgctcgtcggaagcggagtgccacatctatgtgctccctgttcaggacgcgggagactttttcttcctgcgctccgaccaataccccttttcccgttgacctccggctacaccggaccgcacggcgggcgtacaacatcggttacagcggcgggcaaatccccgccttagcccgttacatacagcatacgattttagaccggaccatcggggcgtcccacagcaggatgtaaccgatggtccgggcagttttttgccgtctgctctggctttttgtacggcgcttcatccgttacattgaaaatttgtagatgtcctatgccacctaccgatacaaacagacctcaaatctgagaggagggctaccatgctctatgaccgcagggattttggcctgctccgtctggccgggacctatcaatggctccccctggccccgctgcgggccctttcctccctgaaacacctctaccgtgaggcggagcttctgtccacgctgggactgttgagcttttcccgcagcaatcaatacctgatgccctccccggagggttatcaattcttggtctctatggaaatcgactgccacgcccccaccaaacgcccttacgcgcaaagctccgccctacgacggcggttagaggtggggaccgtcctgctcacctgcctgggggcaggaattgagccggcctatgacaaagtagaccgcttaaaacgccaaccggtttttctccccgctttcgccctgcgcggcggggacggcaatctgatgaacgccgccagctgtgtcggcttcggccactggggaaaccacgcttatctcctccaatatgtcagccggcaaaatcccggcttttttatgaacaatgagctgtcccatctctataacctggcaagcgtgttcagtgagcgcctggacacgccccaggcccttcttttggccggagagagctatcggtccatttatgaaatgctctccaaccagaccccatcgggacggaacgggaaaaagggctttaccgattacagccaggcatatccccggcttggtattccggtgtccctggtttcctgtgacgataccggggccatgcagctggcgatcatgcgccagatggattaccgcacccggattgcgcaggctgcctttggagcccggtggaagccggaggacgaccgcctcccggaagcggacggccatgtggacggcaatcccctggtgatcgcggtggacatggacctgcgccgcttggagcgggtctgccgcgacgcgtgccaacagggacggcgtgaaatccttgtggccgccctggagggccagatgtccggcctgctcttggaccaatttccgcgtagggcgccggtccgggccctgcgtatcaatacccaggtgcttgcggcggctttcggagaaaacttttccgcaggcgatccctggccgaatgagccgcttcgctggaaaggcgggctgatccatatttaggctgtcagataaactggcccgcctggaggaccgcatttcggggcgatggggaaagaagctggaccgttttttcgaccgccgcaagggaaagtggaagttttatatcccgctggggctgttctgctggtacttttacggaatgctcatcaactccgtccacctggggatcaaatctactttcaacgcgaccggcgatccggtgggctccatttgggtcgtcaacccattccgcaatctgctggccgtctttacccccacaggcctgggcgtcacggcagtcggctttatccttttttgtctcatcaccaaaaagggctacatctggttttccggctacaagtttatccgggacaaacgcggctttgacattcttcccgatggcacacacggtacctccggcttcatgtccaagaaagaacaggagaagattttgctgacgggccccatctcggagctgtccgggacgcttctcggcaagctgaaggatgatccggacgatgatgacaagtacgctgagtatgtgactctgcgccccaatagcggcctgacggagcacatcatggtgtacggcgccaccggcgcgggcaagacccgtggccttgtgaagccctttattcttcaatgcgctgctaaacggagcacgcaggagagcctgatctgtgtagatccgaagggagaggtctacgagagtatgtcctcttttctccgggaacagggttatgaggtccggatgttcaaccttctggacatggaaaacagtgatgcctggaactgcctgagcgggattgagaaggacaaagacctggtgcagtccatcgcggaggtcatcatcaagaatacctccaacgccaacgagcggcaggacttttgggaaaaggcggagctcaatctgctcatggctctgatgcactatgtcgcaacccagaccatccccggcaccacggaactgctcccgattcagcagcggtctctcggggccatttaccggatgctctccaacgagtcctttggggatctggagcggcgctttgaggcgctgcccaaaggtcacccggcgctggcgccctatggtattttcaagctggccaaccggcagatctggggcaacatcgccattggattgggcaaccgcctgtctgtgttccaaaaccctttggtggacaaaatcacctcctacaacgagatcgacctgacgcttcccgggcaaaagccctgcgcctacttctgctgtatctccgcgcaggactcctctctggagtttttgagctccctgttcttttcccagctcttcgcccgtctcattgagtacggccggcgtcacggcaagcatgggcggctgcccatgacggtcaatgtatgcctggaggagttttgcaacatcgggaaacttccggacttcaagcgggtgctcaacttctgccgcggctccgggatcttctgtcagctcattgtgcagtctattccccagctccaggaccgctaccccaaaacggagtgggaggagctgatcggctgtacggatattcagatctgccttggatgcaacgatgtggacacggcgacctacatctcaaaaaagtgcggcatggtcactatcaaggtggagaacaaccaaatgccacttttgccgttgttttctccggtttatagctccacccgtccatacagccagaccaagagcaacacccagcgggccctcatgctcccggatgaaatcatgcgcatggacaatcaggagagtctggtacttctccgaggtcaaaaaccgctgaagctctacaagatcacgccggacgaacaccccagcttccagcgtctgcacgatgttaaggtatcagactacacccctgaatggcgccgccaggaggagttggccaaggccgaaaggaaggcccgggccaagtcccggccagcgccgtccgcgccggaggccggtcctccgcccgctcagccggcaaatacggcgccggcaacccctggccaaaaagaagccggcggggagacggctcctcacaaggagcgggatcagatcctccggcaggaatacgactatggacttctggacccggaattggatcgtgtctcctcccagtcgccggacaccgaggccccctatggcgcctttgacctgatcgaaacatccccggatgaagtgggcgggccataagccgttccatgtccctacgccgctgacaatcaacaaacttgtgtaaaaaaggagatggtcccaatgaaggcagcaccaataacgaaaaagccgtctttcccactgatgaagcagggggacattcagaatatctaccatttgcagatgccccgctggctgtttaccgatccccgatacatagggctctcactggaggctaaggtgacctacacctttttactcaaccgcttccagctctcccggctcaacggctggctcaatgacgacggagaggtgttcatcatctacacccgccgctctctgtccagcgaaatgcaggtgagctatcacaaaatcattgaggcgatgaaagaactgtcctccgccggcctgatctgggagcgccggtgcggctgcggagacgccaatcagatttaccttgccctggtggagcaccgggagacggcaggcggcagcgccccctttgtacctccggaacatgaggccgccggaggggagcagccggtacccgctggtgggtcggctttggagacagggccatccggcaaggggcgtactccaccggagccgcacgaggcacaggcccctcccgcctccccaagaagtgcgggatcggaacttcttgtccccgctcagccggagcagcgaggcactgcggccggtttagaagtcccaggcccgaacttcttgaagtctcaatccggaacttcaagagattcggaaacggaacttccagaagttgaccagcgggactccagttatattgacttaaatcatactgatgggattcatactgaattcagtctgtcctgcccgtccggcgccggagaccggatggacggactggggccatggtggagaaacctgtccgagcaggaacagcttgcgcagattctggagaactgttccctgtgggtctttgacccggaaacggcaaaggtgtttgaaaatgccattgagcggctgttttatacccaggaatatcggatcgggaaggctgtcctgccccaggccaatgtgcgctcccgcctgtgggatctggacagcaccatcctccagtccgtggaggggaagctccggcaaaaccagcgcaatgtcaagaactcgaccgcctataccatggcggtcatttttaacgccatctgcgaatcgcaaagcgatcttctgcttgacccctatctcaacagcataggcggagccccggcagggagtgagaaaggcggtgaaaatcaatgcttttgacaaatgaccagcggtttctcctcgacatcctgcgggaggtccgctatatgcggctggatcagattcttccgcttatgcgcctccgcgatccagccaaagccaagtcccactgtgaggcgatactgcgctatctgcgctatgcgggagaactggtccccgtgggagacgatctcgtatgtctggcggagttccgggggcaggaggcagaccccgagatgctgtgcgcgctggacattttgctgtctctcgccgtaggcccgccgcttcagctcaccagccggaggccgccttataagctctgcttcctgctggagcggggaagggagagtgggaaaatcgacgcattcgcggtcctgccggtggagccgggacgggaacagcttgtcagcatccttttggcgcagcagtctcaggatgtgaccgtgcttttgtccctgtccgatttggaacagcaccggcttttacatatcaatcagcggcactacttcgtcatccggaaggagggtcgcctgcggttctttaagggaggtgaggccagccaatgacagccgcagtaagcgaacaacttagcccaatcagaaaggagccagactatgagctacacagagcatgatgagaccatggacagccgcagcttggacggtatcacagcttcaggcgctgcggaatcttcacccgtgggcgtttctcaggaagcgcccggtgtggagagggcagatcccgccggagacaggacagaaggcatagcccccgtcctggaggctggcaccgaggaggaggcgaccgcccccgcagcccaggcggagggaggcgggctggacccgcctgaagctcccttgccttccggtgaaagcgagcagaccggcgaggctggtccggaaacaccggtcgaagaaaagccaaaacgcaagcgggtttcccgcaaaaaggcggcggattccccggaagatacatccggcggcgaggccgctggggaggccgcccaggcgtctgaggaggaagatacctccagcggcgcctcggatgatttgagcgcccagggaggcgatacgccggagcatgacgatgacgaggatctggagacggatgcctttgtcctgagtgatggtggagaagagatgccgcccaccccattggagggtacaggtgatgatgatacggcagacgccccaatggaaggtcccgagcccgcgccgtctcccaaggcacggccggcgcggcgtacagcgtcagcggcaaagacggccaacaggcctaaaaaggaatttaccagcaggccgttgaaagataagcccacgctgctctccctggatctgaacaagctggacgaggacctgtccgaagaggagcggaatgaatggaatgccatctatgcatcctaccgttccaagtccattctcaccgggcggatcatgggcatcgacacccattcctttactgtccgcaaccgggagacaaggcaaaccgagcggcgcaagatgctgtgcgccgttatcatcaactaccgggtcaaggtgctgattccggaaaccgaagtgtggtacccaggccaggagcggccgccctatgtacttcgcaacatgagcggcgcggagaccgactatatcatcctggatgtagaccgcgagggcggtgtggccattggctcacgccgaatggcgctggccgcccagaggcactttttcgataccatcaaaggagggcggagcattggcgagaagctgacctgccgcgttctggctgtgggccccaggcggtgcctggtggagtgtggaggcagggatatgagcctaagccagaaggacctcacttacatcgctacacctgatctccggacgcggtatcatcccgggcagactttgaactgtgttctgaaggagtacgaccgcagagaggggcagttctgggtttcagtaaaggatacagtggacaaccccttttttggagcgctccgaaggcaccctatcggaagccgccggcaggcggtcatctccggcaaatacggcggcggcgtgttctgcacgctctccgacgaaacggtatgtctctgccactactccacactgcactcagacctggatttccatgtgggggacacggtcattctggcaatcaagcagtttgattatgaacgcagcctgatctatggccgcatcctctccaagtggtgagtagaatggcagatgaaaagtgtctcctggaagatctccaggagcttgtaggctgtctctatctctcggatctgagactgctgtgcagccgtgagcgcgttcgtcaggccctgaaacagctcaaagcggaggattatcccccggcccagtggcaggatgcagctcattatctgatgtcctaaggtgcagccaagccctgccgtcttatacactgatatgagaaaagcgaatgcccgcaggccttctttaggatgtgtcctgcgggcattccacttgcaatattgataaagtaaaatggtaaatttcgtttcaggccccacatcgcccacccagtattgattgtttctttatccttctctgaaatacataggggctacgatccgtttcagaaaaccttaagcgccgcttgacgcatctctctgaaagttgtataattttatgtggttagtcatcgctaatcggcgaaattatgaatggaggtattcctatgtccctgattcaaaaagaaattgccgatttctccgtccagtgctatcagaataacgccttccgcaccgctaccaaggcggatgtactgggaaagtggagcgtgtttttcttctatcccgccgacttcacctttgtgtgccccacggagctggaggacctggcaaacctctacgataaattccaggccatcggctgcgaagtttactccgtttcctgcgatacccactttgtccataaggcgtggcatgacgcctccgagcgcatccagaagatccagtatcccatgctggctgatcccacacattgtctggcaaaggattttgaggtctacatcgaagccgacggcgtggcggagcggggcagcttcattgtcaaccccgaggggaaaatcgtggcctatgaggtcaacgccggcaatgtgggccggaacgccgacgaactgctgcggaaggtacaggcgtgccagttcgtggcggagcacggagacgaggtatgccctgcgaagtggcagcctggcgccgagactctgaagcccagtctggatctggtggggcagctttaagccatggagcagacggcaaatttctacgatgtcgtggtcatcggcggcggtccagcgggactcactgccgccctctacctggcccgtgcccgctaccgggtagtggtcgtggagaaggaccacttcggcgggcagatcaccattacctcggaagtggtgaactatcccggcgtgggcaggaccagtgggacggagcttaccgagaccatgcggaagcaggcggagggcttcggcgctgaatttctgctggccgaggtcaccgggctggagctctccggtgacataaagaccgtacgcaccggccggggcgatttgaggtgcttcggtgtcctcctggccaccggcgcccatccccgcatggtgggcttccagggggaggagcagttccgtgggcggggcgtggcctactgcgccacctgcgacggagagttcttcaccgggaaagatgtctttgtggtgggcggcggctttgctgcggcggaggagagcgtgttcctgaccaagtacgcccgccaggtgaccattctcatccggggagacgacttcacctgcgcccaggcaacagcggatgcagccagaaaccacgagaagatcaccgttctcaccaacacagaggtggaggaggtgtccggcgacacttctctccgctatctccggtaccggaataccaaaaccggtcaagtgaccaagcaccatgcggcggacggagagaccttcggcgtgttcgtttttgccggttatgagccggccacggagctggtgcgcggcctggctgaattgaatgaccagggctatatcctcacagaccggagccaaaagacaactgcggacggcctgtacgccgcaggtgatgtatgtgtcaagcctctgcgccaggtggttaccgccgtgggagacggcgcccttgccgccacggagctggaacacctgtgcgccgccatgcaggaaaagaccggcatccatcccaaagctccggtgagccgggcagaagaaacagcggtatccaccgaaacaaacagcacactttttacggggggcatgctggcccagctccatacggtatttgcccggatggccgctccactggtcctgcggctgtatctggacgaaacgcctctttcggctgagttgaagcagtatatggaggaactggcggcgcagagcagtaagctcacagcagagataggaacagccgaagagatggagcacctgccctgtgtccgggtctgccggccggatgggagctggacaggcctcgctttccatggggtccccggcggccacgagttcacctccttcgtcctgggcctctacaatgccgccgggccggggcaggctctggacgaagatacaagagcagcgattcagtcggtccagaagcctatcaaattagagattctggtctccctctcctgtaccatgtgcccggaactggtgacggcggcccagcggatcgccgcggaaaatccgcacatcaccgcccaggtctatgacctgaaccacttcccagacctgcgggagaggtatcaggtgatgagcgtcccctgcctggtcatcaatgatggggcgcaggtatccttcggaaagaaaaacatccggcagttgttagaactcttaacatagcaaggaagccgcgttgcgggccgtttggtctacaacgcggctttcctctgcaaaaaatgcttgtagcgcggagccttttggagtattctttagttatcaagaactaactccaaaagaggcatattgctatgaggaaatcagatctggacttctggcagggaatggccgcacattacagcaaattcatgcggcgctccgcaccgatatatgcggaaatctgcaatcacattcgtccgcatctcacccgggatatgaatgtattggaactggcctgtggcacaggccagctgtcctttcccttgtctccgtatgtccggttgtgggaggccaccgatgcctcttccaaaatgattgcggaggcgaagaaacagaccggatcttcccggcttcatttctcggtacaggatgcttcccggttgccgtatgcctcggaaacctttgacgcggtggtaatcgccaatgccctgcatatcttaccggagccggaaaaggttttgcgggaagctcggagagtcctaaagccgggtgggtggctattcgctcctacttttatccacgctggggggaaacttgccagcctgcggacctggggtatggagcggaccggctttcgcgtctaccacttatggaacgccggggaattcattgcttatctttcgtctcacgatttctgggtgacggaacacactctgctcggggggcgtgtactgcctttgtgctatgtggcgggcaggaagtaactgcccagaatgggtcgaaggcgggccatcggcgctgtatgacggtggcccgccttctgataatcaatgaatgcggactttttgtgtagagggcaaatacaaacagcaaataatagggacagtcgtttggaactataaattttcactccaaacttcatgttgacatatttccagacggccattataataatagtagcagggatggtttctgcatgagacgagtgacggttctgactcgtcggtaaaataaaaattgaccgagcgaagatgttgagtgacggtactgactcaacggtaaaataaaaattgaccgaaagaagccatccggcggggagggatcgccctccccgcttttcttttgttatgggggcgaaaaatggagtatattgcggagatccacagcctatcagcaaaattttttacagattacccccacagtcagtatccggagattgccgtaaagaaaaacaggccatactcctgtctattgatcgaatacatggacgacctgttcatctgcattccttttcgttcccatatccgccacccccatgcttatcatttcaaaagctccgccagatctcagcgcagccagtccggccttgactacacaaagtccattttaatcaaggataatgcgtacatagatgccactgtaccggcactcgtcgatcaggacgaatataaagaaacgatggtcaacttgccgcgtatcgtacaggaggttttttcgtatatttcggattacagggatgatctgaatgaggtccgcaaacttcacccaagggagtggcagcgacgctatggccggtctactctaccatactttgaaagttttctacgaaatacaagcgccagcgaatgaaaaccgcccctctgagcaaatgctcggaggggcggttttgtgcttcacacttatattcaggttggtgctgcattgtggcgtctgcttctttatttaattgcgtccttcaataccttgccagccttaaagactggcatcttcccggctgggatcacaatgggctcgttggtcttgggattccggccggtacgctcggcgcgctctttcacttcaaagctgccgaagccagtgagctggaccttatctcccgcgcacaacgctttctcaacctgggagagaaatgcgttcaagactttctccgtatccgctttggagactccgctctcctcggccataccagcaatcagttctcccttgttcataaagcaaattcctttctctttctattgatttggataagcactctttacatgataaccgcatcggcagcttaccacagcggtgaatgctcaaggcaaagcagctgagggaggaacgccccccagccgcagccgcggtcagcacatgtctcgcacccactcccggacctcttccaaagtcagctcgaagcggccgcctgccgcaaccgcattcccggacatatccacgatcatatagccgccaaggttgtccgagctgatgggcgcacgggacttccgcatcctgtagccagccgccttcagcacacggcggagcgattgctccggagagccttctgtacgcattgaaatacctcccaatttgatattccgagccaaaccacgccgcgctccaatcgctttcctgctggtattatagcagggaagtcatggaaaatgcaactgcacggatcattttacttctctctttggaggtatcatttatcccaacgaaataaaagagctgagggccagcgcaatttcctttatctcttgtctgctggtattgacgcagagatcgtaatttaaccggtctccccatttcttccctgtataatattcgtagtatttccgccggtttttatcaacggaaatcaccttttgcttcatttcttccaacgaatacacttcttctgccgtgcgccgctccatgcaccgggcgatcctatgttccaattcggcatagacaaatatgcgaaacggtcgaacatcctctaaaatgtggtcaccgcagcggccgacaatcacacagcttgacctttttgccatttcacggatgatcctgttctgctccagcataacagcctgtctctgctcataaatcggattcgacaatggataaagactgcggccaatatggatggggaaggcgggaatgggcttttgctcgatgacctgctcgatatatcgctcagccagatcggtgcgcctggagatctcagtaataatctcctggtcataataggcgatattcagcagctccgacagtctgcgtccaagctcccgcccgccgcttccaaattccctgctgatggtaataagcgtgttcataacctttgccccttttcaaaagataatttttttgtgtattttacaatggtatgcgccgcatacacagcgactgccagctctgtaaccggcatggcaagccaaatagaatcggctcccgctacggcggggaggaccatgatcagaataccgctgatgataaagcctctggcaacagacacgataaatgccgctttcggcttcatcagcgcctgaaagtaataagtagaaaaaatgttgagcggcagtaaaataaaggaaagtccatagcagcggatgattgcgggggccatctccaatatttccgttgtcggcttcatgaaaatataaatatacaggttcggacaaatcaagctaagggccgtccagaaaacgctgaataccgcgaccgtatagagcgcataccgcaggacatccttgatcctctgcccataccttgcgccaaaattgatggagataattggctgtgacgcctgcccaacgctgtacgcgcagcactggacaaaggtactcacattcacaatcgggccatagatcgccagcgcgcttgtgcctaaatacttcatgatctgccggttaaacaggacggtcaaaattcccatcgcaacatcaatgaagaaggtagagaagcctgtcacggatatttccttcaacttagaaaaaattctggctggcttttgaaaggccagtgtatttttctttgaccagaagtgggacagcatgacgaagaacgagatgccggagcctatcgccgtggcaagccccgcgccgtaaatccccatgtcaaaggtaaatacaaagatatagtcgccaaaaacattgaacaggccgccggccaagacacctgctgttgccagcccgggattgccgtcatttctcaaaaatgcagccagcatctggttgaacaggaaaaacggcacaacgactttaatcggttccagataggtctgcgccagagaaagcagattgatgtccgcaccgaaaaacagcaggatcggcttttcaaagaacaaaattgccagccacgctatcaccgacaatacggcggcgccgatcaccgccgttgtaaaatattcattttcaactttacctttgcgctccgtttgcccccgaagggtactaaagataacggagccgccaatccccattaacaggcccaggctgtaaatgatgttccaaatcggagcgacaacagctaaagcggccgtaccatccggtccctgatattgccccaccatcgccatgtccacgatagagtagaccgatgtgatcatggcgctgccaaaggcggcggacagatacttgaagtagattggtcggattttcccggttaataagtccatttctttccctccctgcaaaataaaaaggccggataagaaagccgcacataacggttttcttatccggcactctcatacgcaagagtaaccctccggcaaaccgcctgttcggtatcttatccggccttatccctacgatgataagtcctccgacggtggcccattataccatattcaaaatcattgtcaagcaatatgttcggatttatggtgtccgcttttatccgtaagataactgtccatctccgcccatgagagcggtcatttcctcgattttttccaatgggaacggtggttgggagagtggtttcatcgcaatcgacatcagcttcatgggattatcgtcggccgccacccggtttgaacttaaatgcccgcatctcctgcatcggtggatgatcgcccactcgccattttttctgacccaaacgcccaccgggtccatgatccctccgcagtctgcttcccgatctccaggctcaatgtccaaatgcagactgctgagacagtttgggcaatgattgcggtggtcgcttcccgctccggtgggcacgactaatctgccgcataccttacaggtgaagctgtcgctgcacccatgtgttttatagtaccctttttcatactgcttgcgcttattttctctgttcataactgctccttgatgggcgaggacagatacgattacagatcttcatgcaggtattttttgaacgagtcccggtacttttgtgtgaatagaagataccgctcttgctcatcgactgtccattcgctccatatcttattttcaatctggaatagtgggcggactttttgagcagaaaaatcccgccccttttcggtcaaacagaccaatgtattccggccttccccctgcttcagataggcaagcccatcccgctccaatttgcggatcgccgagttgatcgtttgccggctgatccctgtcagtctgaatatgtcgctttgaaggcattgtccttcctgctcgcaaaggacatacagaatatccaagacagtatcagaaacgcctatttttacagctgcttcatgatatagggaagtgatctccgcagacagataggcatattttcttgcactttcgcagttcatcacggcctccttaatatccgatttcatatatattatatccgttttcggacatatgtcaataggaaattcaaaccttctcaatctgatttgattaggcagcagcatagaacatcatagtcaatatagtggctgctatcaatctttttaggtgtataaaattacagatgcacaggtcattttagaaacgcccgccccgtgtacccaataagagagcattcagcaatcaaaaacgcggtgcggacattctgatctgatatgtacccagaattctggacacataaaaaattgaattaggtgcacatggatgcctctctgaattttgtaggaggcatccattttgttttctcttggattctttcgttgttgtagtaatttatgtagccgtcaacagccttggcaaatgtttcaaaagaggaatactctttttcatgcccgtagaacatctcgtttttcatccgtccaaagaaggtctccatgatgcaattgtcgtaacagttgcccttccttgacatggattgaatgattttgtgatctttaagtgcctgcctgaagtacacgtgctggtactgccacccttgatcagagtgaaagatcaggccatctacagagggaaacttcgtaaaggcgccggccaacattctctggatctgttccatattggcactttgagataaatcataagaaatgatttcgtttgtgttcatgtcgagtataggagagagataacacttcccccacgaaaaaccgaactgagatacatcggtagtccatttttgcataggagctgtcgtgctgaaatcccggtcaaggatattctcagcaaccttgccgacctcgcccttgtaggaatgatacttttcctttgggcgctttcctgccaaccccatagtgtgcataagccgttgtacccgcttatgattgaccttgtggccgcgctttatcagttcctgatatactcttcgcacaccgtagcggcctttatgctgtgagaaaatgtctttgatttcatctgccaagcaatggtttcgaacagcaacttgatcggccttgctcaactcaaaataataggtagaccgtgccatctgcatagatttcaacagatatttcaattggtatcctttttcacgcagctctttgatgatcgctgctttctcgccttgagttgcgctgcgtgcctctcttctctcaaggcgatctctttttttataacttcattctccgcctttatatactcgttttctgcccgaagccggatcaattcttctcgttcggattcattcagtggccttgcttcttcctttttcatttggggtacccctttacttggacgaccttttttcatttctaccaggccattatacccctttgttttatagttttgaacccattgatacaatagtctatcttgaataccggcctcgattgccactgacacacaggattttccggacattacttgggatactagttccagccgttcttctggtgtccagttcctgttgaaatttttgtgtttcagtgcttctggaccgcggctatcctctgctcttacccatagtctcactttatcccgaaaggatttatcgctaacaccttccggcgtttctggccattttccttctcgatacagttctacacatttccttttgtactcatacgtgtaccgcataataataccccccctactgggtgtccagtaaagggggtacatatcactcacaccaaagcgccgtttttattttgtatctgcctgctggccttgtcttagcctgctttatgtgtggtccatacctatggcttttgggctgtgacacacagccagttccgatcctctctctgatggatctcgacttgaataaatcccgctgcccagagcaactcgaagagccgttcgccggtgtagatggtcatgccgccgatgatgtcacaccatttctcctgtttggggtcttctccgtttgactcgttgcagacaagaaaacttccgccgggtttcagcactcggaacacctgctgaaaggcctcctccaaattgggccagaagtaaatggtttcaaatgccgtgacctgctcaaaggagtcatctgcaaaaggcagttcctgcacatccccctggattacctggcaccgtccctctgcgatggctcggcaatttacagcgctcgcttttttcacgctgacggaggagtaatccagacccacggctgtgccgtctggacacagcttcagcaggacggccagattggctccaccgccgcagccaaggtccagtatggtggctcctgctttcagtctcaggaagctccgcccccagcgggccactggagcgtgtccccagttcatcatggcgaccatcagcctcccacccaagccctccggctttcgggtgttggtaaaaaatccgcccactgctatccctcctgaataacctgctcataccttgtcttgctggagtaattcctccatcagtctgtccgtgattgcgggggatgcgtgctcttccccctccagtttgataatgcgggcatgaggaagttctttggcagtctcctccatggcactgtaaggcacctcggaatcggctgttccatgaagcaatacaaccggacaccgcacctcagacagcttaaatccccaaggtgcttcctggagcttggcttcctgaccgatattccggagatcactacccatagagtcccgaaaatcccgactctgcaaggccgcctcgggaaagaggggaagataactgtcatataaagcctgccccgcctcttgccgtgacataccgcggaacgcacgataaagcgccgcatcctgagccggatattgcgccagaacatttgggaagcagaccgcaggtatgccgctgttgatatagagcgtgccaattcggtcaggatagagggccgccagactatacgcataaggcgcgccggcggagatacccacgatgtcaaagctccagagttccaagtgatcccaaaattcagccagcagccggccccagtcggctacgcagtccatatcgaaatagtcggaggctccataaccagggcgggcaagagcgattaccctcacgggcagtccgcaaagagactcctccattccctctgaacatatgcttcccaccaagccgtgaaacaagagtaccggattgcccgttgatgtcccgtattccgcataggacaggcttgcaccatttggaagctgaaaagagcctaaacgcatatcgttcctccatttccctgattgtaaattagcgttcctatatagtttgccgccgctaaccgaagtataacacgcaagctgtggagcgtcaatcacatacctttcctttttatcagctacaaatctctgcctatacaaaaaacgcagttacccatagaggataactgcattttttcggaaaaggcttctcaggttatgggagacagctcgaacttatagccgctgtgggggacggtacggatcgggttgcccagtcccatcttccggcggagctggctgatgatattgaccacggtcgcgccgcagtcctccggaaactcatgccacacagcctcgtagatctgttcctgcgtgaaaatccagccggggtgccgggccaggtaggccagcgtgaagaactccaggtgcgtaaggtggagaggctggccccgccactttactgtctgcttgcgcaggtgcagctccaggccgggaaaggtgagggtgtgcttcgtagcgggcggctccacgatttcgattccaggctcttccgccaggaagtccttgatcctatccagaatttgttgctcgccattggtgacggataaaatcagtaattttcccacgcggggtcctccctttcttctgactgcttaccggtcattccggctccaccgccccttttaacaattcaaaggaccgctggctgatggtgtgctccatccggcaggcctcccgttccgcggtctggggatcgaccccggccgcaataagccgccgggtaaagaagcagtgtttttcataggtctgctcggctacctctcggcctatatcggtcaagcgcagagagaagtcctcatccatgccacgatagtattagggcaatcatgaatttgagctgtccttcatcttgatacggatcgtctgccgcgatcccagcatggaacagaccgctcttgtcgtttggtcgagagtgagggcaatccatgctccgtataatccaagaccaagttcgtaaaccaggaagaaggtaaggatcggccgcaccactgcgatgctgataagagaatagagggccacaaaactggtatgccccaagccacggagcagacccgcatggaccatagcccatgcctccggaatattgacagcagccacaaagatcatgatctcacagcccagagccaggtcgttgccctccagatggtagaactgaagcaagggtgaccggagcagcaaatagagcagcgtggccgcacccccagtccaaagcgccgcccggcgggatacggccccgatccgtttcaggttgcacgttcttccagatcccaacgcctggccggcctgaaccaggctggccttcccaagcccttgggagaagctatagtaaatgtcgcacaggctcccacagatgttgtggacgcttagcgccgctgtgcccaggtctgctaccaagcgtgaaaatgtgaacatcccaaaccgttccgctgcctgctccaggaatgtgcccgtggcaaggggggccagggagcagaggtattcccgttccggcagccaggcccctctgccccgcagagtggccggatgccgccgccgtaagaaaagcgccagcgtatagaccagcgtggcgccagcaccgatagcagttcccagcccagcgccgaaaactcccaattgcgggaatgggcccagaccgtaaatcagcagcgcattgaacacgacattgactccgttgcctagcacattggacacaagcacgcttttggtatcgccaagccccgccaagatgccgtgaaggacaatagccggaccggagagcgccagactcaccagggtgggaaaggcatactgcaaccccaagttgatatagtcatcctgtgcaccggccagtcgtagaagcgggccagctccaatccaggtcccgaccaggagcagcatcgagagaccgcaccccagcatgagcgaagcgcgggaacaggaggtcagggactcatccggatgcttgccgcgccggcgggcaacataggcgctcagtgcaacagagtaggagcgggttacgcagaggatcaccatacggggctgggaaaaaatactgaccgccgccaccgctgtgtttcccagagcggaaaccatcagcaggtcggcggcggtgagcagcatcagcaacaggccctctgccgcggcgggccaggccagccgccagaattccttacggatggccatatgcgatcagcggatctcccgcccggacgcccaaggcgattgtgtagtaaaggacaatgccgtcaaactcggcccgaacctcttgtaagcggcaaccagacagtgcctccaggtgtccgagcagttctccccttcggacccgttggtctaaacctactgccggataccaaaatccctccgactcagcttctgcatagaaggtttctgtgatctccagctgatcccgcggcgggttccctccgggcataatctccagatggcgcaacagggagcggacgtcctcacagcaggcgtccacctcctgttcagaccaaagcccctgcccgcccctctcaatcagcagtgcgggaatgtctctttgcaccgcccagctgtaaagcccgttcttggcggtggagcggacccggtagggtaccgtcaggaccttggcggcatccagtgagacttggttgaccattttcttccctgctgccgggaagaacaccaatggatgaagcgtttcgctgcagtctccgctgtggagatctgccagcagatcggcttccgggtataaagccgcctccagggcaaaggccaatcgagcggaaagggggcccgcagagttgccggggaaggctcggttcaaattgacgccgtcctccggcaccacctgtttggctccggcataaaaagcactgggatttgccagcggcagtaggatgacgttccccgacagcctcgccggatccaggtccgccgccagacggcgcagggcctgaattcccacatactcgcagccgtggacccctgccgtgaccaccagcgtcttgcccggggcggcaccgcacaggcagagcgcattcagggacggagcatccggtaccgggagcggtacgttttttcgctcaccaggcaaaagtgttatcccacaaaaaatcatacgtccacctccgaagtctcggtgtcaaataccacaatggactccagcaaccgccgggcgtactcatccttagtctcgctgatgcggctgacgggcaaatattctgttacacggccctgatagaggaacagcacatcgtcacagagatatgtgatcgaggtcaggtcgtgggtgataaatacataggtcagccccagcttttccttcagatcccgcagcagatccattacctggacctgggtatgcgcatccagggaggagatcgcctcatcaaagaggatgacctctggcttacaggccactgccctggcgatgcacacccgctgaagctggccgccggagagctcgtggggaaatctgcccgcaaaatcagcagggagtcccaccagttccagaagggcggccatttccttctttcgctccagccggcccccctcccggcgctcccggacggtcaggccctcgccgatgatgtctttgacacggaaacggggattggcagaggttgtgtagtcttgaaataccacactgagcttgttctgcaggttccgccggcccgctcgggaggcgtagaccgatacgccgtccagaatcgcctcgccgctgtccggtttcagaagcccgcaaagcacccggcccatagtggattttccgctgccggactctcccaaaataccgaggcaggtccctctttttacgttcagggacacatcaaagagcacctgctgacgggtatgtccgaacaccttgtcctgacgctcgcttcggaaactgacgcagatatttttcagttcaagcatagacacgctcctttcctcccagcacctggctgtatcggcgcatcacatccgtccgcttttccaccagcagcttggtataggaatcggttgcatggtgaagaatgtgttggaaatcgccttggtccaccacaagcccctgattgaggactacgatccggtctgccacacgggaaatcgcattcaagtcatgggagataaagaccatcgctgtctggtgttcctgcttgatccgcagcaattcgtccaggatctcaaattgagtgatggcgtcaatagctgtggtaggttcgtccgcgatcagaagggacggcttcatagaggtcgcaatgccaatcataatccgttgaagcattccgccggagagctgatgcgggtacttctccaacacctcctccggattacgaatccgcattttctccagcatctccagagaacgctggcggatatccgccttgctccaatcattgtgggccgcaaaggtttcggcaatctgggctccgatccggtagagaggatcaaaacaggtcatcgggttttgaaggatgatgcctacctgaccgcctcttagacggcgcagttcttcatcacttctccccagcagctcctctccctggaatttggcacttccaagcacgtggaagctatgatccaaaaggcccatcgccgctttcatagacatggattttccacttccggactccccaaggattccaaggcactccccaggatataccgagaaggaaactcccttcaccaactccaccccctgatgccggtgtgtgcagagcagaacatggagatcttgcaattccagaaccggggtcatttttccacctccttggggtccagcacatcccgcagggcgtcgcccatcagattaaagcagcacaccagaaccacgatggcaataccaggcgcgatcatctgggttggattactggtaagtacatccttcgcctcgttgagcatggctccccattccggggttggggcctgcacgcccagccccaggaaggacagggtagagatattgataatggcccagcccacatccagagaggccagcaccgcaagatcagaggtaatagacggcagaaggtgtcggaacaggatgaaccgctccggcattcccacgcaccgggagaactgaacaaagttccggtcccggtactgcatgacaccggttcggatcatgcgggcataccacgcccatttgatgaacacattggcaatgatgacattttggacattgatccccagaaggcccaccacggcgaacaccatgatctggctggggaaggaaagcatcacgtccaccacccgcatgatgacctcttccaccacgccccggaagtagccggccataacgcccagcagcgcgcccagtgcgatggtccccagcatggtcagaagggcaagtcccagcgttggccggatgccgtaaatcaggcgggagaggacgcacctgcccagatggtctgtgcccaatgggtactccaggctgtacggcgcgaatttgttgaggatatccgtaacatagggatcatgcggcgccaggagcggggcaagaatgccgatcagcgcgatcaggaggacgaaagccaccgtcaccacagcggcacggttgtgcagaaagcgttttcccatggctcagctctcctttctcagtctggggtcggacacggtctgaaggatgtcgaacaccagattgaataccacgaacaatacgccgatgaacagcacataagtctggatgaccggcagatcacgattgaagatggaactgatgcacagcgtccccagccccggccaggaaaacacgttctccaccacgatggtgccggcaatcatctgggggatgctcatacccatggccacgatgcaggtgtgcatggaatttttgagcacatgtttcacccagatggagcgctggggcaggccgcggacattggcgtagagcacataatcctgcttcatattctccagcatattattgcggatgagccggatataggtagagatgtaactgagcgccacggtaaaggcaggcagtatcatatgctgccaggtaccgtttccgttggtcggcagcagacccagcttgacgctgatcccccacatcaggagcagcccaacccaataggcaggcatggccgtggagataaagaccaggccccgcataatcttatcaaaccagccatccttgtacacagcgcagaggaagccgatagggatgctcagcagcagcacgatcacaaacgaggccgccgccaactgcagcgtggcgggcaggcagcgggccagttctccggcgactgtgcgggcgggattgacatagctgatgccgaaatccccctggagacagcccaggacccagtcaaaataccgcaccagaaaaggtttgttcagacccagcgcctcctccatctccgcaatcgcctcatcagtgataatgggcgtctgctggattcggaggacgacctccgccggatttgaggggatcaggttgatgaacacaaaacagacaaaggaaatcgccagcagcagggggattgccatcagcagccggcggattacatagcgcttcatagatgcccctttcttttttgcatagttgcaaaacttaaactctattttgcggagcccgcgcacgcgtgcttcttacgtgcttcgcacctgtggaaagtgtgaacacccccgcgagcgaaggcaattcagcacaagggccgcctccaaagaagcggccccgatgccatcaacgattactcgaagtacatgcttgcgaaatccacatcatactggtcggtgccgaagtggacccccttcagttccgaggtataaagggctttgttggtttcgtaggtcaggggaatgtagacagcatcctcatggagccgggtcagaacaaagtcatacagttcctgacgttctgcctcatcggtggaggtgaggatatccgtgatggcctgatcaatctctgccttgtcctccagtccctgctgtgcggcatagtctccatacactggggccctcatagcggccagagaggactggggatcataaggcataccccagcagatgttgaacaccatatcaaaattaccggccttcatattgtcacgataggactgttcttcctcgccgtggatgttcagggagatgcccagtttcaaatactcactctgaagatactcagaaatggtcttctcagtaacgctgtcgctattgtagaggaggtccagttccagtttctgcccattcttggagcggcccccgtcgcttcccataacccagccggcctcgtccagaaggcgggccgcttcctcggtgtcgtaggcatagggctccaaatccacatcacagtagggaacggttggggaataaagggtatccgctgccggttccaggccgtagaaaataccctcggagatggcctgccggtttgtggcgtgctggagcgcctttcgcaccgctgtgtctcccaaaatatcgtgggtggtgttcagcacaatatgccgggtggaggtggggtcagacaggcttacggtgaaccggtcactgtccacatactggctgatggcatcagcgtccagcatgttcttgccgaaaatcaggtcgatctcctcattctccagggccataatgcgcgtctggttgtcggggatgaccttgacggtgatcttctgaattgcgggcgcctcaccccaataattctcgttgcgctcaaaaacggcgtactcgtcagtgacaaagtccgtgagcacataggggcctgtcccgatatagccgttgacaccgttcatcgtgctgccgtcgatcatgcagttaggggaaatcattgcgaacggacggatgcaagccagctcggtgagcatggggtagtacggctcgctcatctcaatgacgaaggtatcctcgtccggagcggacacaccgaccagcagattcatcatctccagccaggtgtggcgctcacggttctccaagatggcgttgaagttggccagaatggcgttggcgtcgcagggcgttccatcggagaaggttacgccgtcccggatattgaaggtataaatccggccgtcatcgctgatggtccagtcttccgccagacagcccacatagccgtcttccgtattgctcaccagggtgtcgtaaaggatgctctgggcgtacatctcaccggcgtacaggtgagggttcagatcccggatatcccggtagttgacaaatatcagctcatcccgcgtacccgtttcactgtctgcgtcggacgagcttccgcttggagccgcttcgcccccttgtccgcagccggcgagcgccgtcaacagcagggcgctgctcaacagcacagaaaaaatccttcttttcataaaagcctccagtcctaaatattacagtcttgcgctatggtttttcattttacagcagttagccaagacttaccagaggccaatttttcatggaaccccataacaatttgttatgccttttacagcatttctccaaagcgctctgtcagccaggaggcctgcggcgagagcggacgctccgggtcccgcacatagccgatttgaagaaacggctcgcatccgttgatggccagcggtttgatgtcatattgctcataggggcggtgcataaaattcaggcccagactgcaaacatccgtatggagcaggaaattgatgatcgagtggtcgctgtcgctgtatatcacgtgcttcataacgctttggtcaatgacccccatgctcaccgtttcaagatgatgttccatagaaaagaaatcccgtactccacgcatgaatttcagatttggaagatctgaaaagtccacactgtccgcatgatacagtgggtgctgaggtcctacgtagacacagatgctcttttcactctgcggaataaactccaatttcttgtggagaagaatgtgctgaaatgtaggcacctgcttttgcgccacatatacgattccaacttcagaaattccttggtggacatggtcggtgatctcctccacggtgccctcgtggtgctcaatatggattccagacccccaggttttgtaaaagtctaccaaaaggcgggacaccatgttgctgggatatgccgacagccgcagaccgttctgctcatccggcacggccagagaggagatcgtagccgttgctctcagaatcagcttcgcatactccagcacgttctttccataaaccgtaggctgtacgcctttcccgctccggaccaaaaggggccgccccagttcatgctctaaggttcggatggttttgctgacatttggctgcgtggtgtacatacaagccgccgcttgcgaaaggcttccgcgttcgcaggcagtcacaaagctctccagttgttttatttccattgatctgtcccccatgccatcggtttgctattgctaaccacaatatactacatctggcgcttgcggacaacaaatatattctcattcaggatgtcatgcacttggaagtgatagaaatgtccggtacaatttattctggtgaaccacaggctgggttccttttgaatggctgattgccaatatagtcaagcaacagtctaagcagtcggtcctccgctttccgtttgcagaaaatgcaatcagggcattcttgcgacgaaggataactggatcaggaacctgttttctggtctgctgcatatctttgaaacgagctttatcaggctatgctctgaatttttactgcatggaatcagttacaaatctctgcctgcacaaaaaacgcagttacccatcaaggataactgcgttttttcggaaaaggcttctcaggttatggaggcagctcaaacttatagccgctgtgggggacggtacggatcggatttcccggtcccatcttccggcggagctggctgatgatattgaccacggccgcgccgcagtcctccgggaactcatgccatacggcctcatagatctgttcctgcgtgaagacccagccgggatgtcgggccagatacgccagcgtgaagaactccaggtgcgtaaggtggagaggctggccccgccactttaccgtctgcttgcgtaggtggagttccaggccgagaaaggtgaggatatgcttcgtggcgggcggctccacaatctcgattccaggctcttccgccaggaagtccttgatcctatccagaatttgttcctcgccattggtgacggataaaatcagtaatttccccacgcggggtcctccctttcttctgactgcttaccggtcattccggctctaccgctcctttcagtaattcaaacgacttctggctgatggtgtgctccatccggcaggcctcccgttccgcggtctggggatcgaccccggccgcgacaagctggcgagtaaagaagcagtgtttctcataggtctgctcggctacctcccggcctatatcagtcaagtgcagggagaagtcttcatccatcgtcaggaagccgccttttttcaaggtcgtcaccgcatgacacacgctgggcttggacacctccatgtgccgggccacatccacggagcgcaccatgcccttttccttttggagcaccagcacggcctccaggtagtcctcacccgacgcgtgaagtttcattttgcctcctatcccatctcgttcagaaaaaagcgcagcaggcgttccctgccctccggctcgcagagggagtagctttcctgaatcttaccgtgctccatgtggataacaaacttacagcaccgcaaaataaattccgggtcgtgcgtcaccacaaccgcagttcttccttgttctgtaattctgttcaccacctccgccacctgccgcatgtgaaacaggtccagcccgctggtgggctcatcaaatacgatcagcggccgttctgatgcaatcgcggaggcgacggccacccgctgcttttgtcccccggacagccccatgggatgtcgctcccgatatgggagcaggtccatctcagccagcacagcttccgcttttgcacggtcctctgttctcatgctcagacatatttcatccaacacgctttctgtgaaaagctggtggtttacgtcctgcatcaccatataacagagcttcagccgctcttttctggaataaatcctgccctgttcctgcacagtgccgccgcaccgcttttccagcccgcacaggcagcgggacagggtggattttcccgctccgttatgcccaatgattgcggttgcaccgcaaaaggggaattccacctcgtcaatgtgcagggtttccggctgatgcttataggcaaaggagaactgccggattttccattcggagtccccggtccggccgtgaggcagcgctatcccctttaggtcgttcaggtccagtgggcgcaggcccatttgctcccgtcgctctgcgggcaggctttggaattctgcggcggtatagtcgcctcggatctctccatctttcatatagaggacacggtcggccagatctcgcaggtagtagagcctgtgttccgaaataacgatggtttttccctgggcctttaggcgcatgagcagttttcggaaatccgcaatcgcgtaggcgtccagattggaggacggctcatccaggacataaatatccgggtcgatggcagccgccgacccacaagcgattttctgcttctccccgccggagagggagaagatgctccggtcaagcagggattccagcctcagctgctccgccaccaggcggacccgctcacggacagccttctcgggcaatccgtgattttccgggccaaaggccagctcgctggtcgtatccacattgaaaaactgggagcgtggattttggaacacagagcctaccatttgggaaatctcaaagagcgacagatcgcgggtatctttcccgcccagatagaccgagcctgtaaaagttccctcgtggtaatgggggatcagtccgttcagcagacgggtcaaggtcgtcttgccgcagccggaggccccgcagagaagaacaaaggagccgtcctcaatcgtacaggtgatatgcttcagcgccccttccgtcagacattccccatccacagggccgcttgccggataggaaaacgacacatctctgcacgcaatcatggcattcacccccttgcagcccacacatagacttgcgcggcaaatgccccaaggcagatcaggagcaacacaatgtcctgtgcgcgaaaccagattttacagatgttggtccgcttgaccggtccgcccagaccgcgggtcagtgccgccgcactcaactcttctccaatcttgacagagcagatcatcatgggaaccatgcggtattccagaatagagccggcctttccaccgccaaagcggacgccgcgcatccgcatggcgtccccaatggcgctccattcttctgcaaccgtcgggaaaaagcggaacatgaccgacatggggattgtgatctgctgcggcaggtgaagccgctccatagcggccacgaattcgctgacggttgtggtcgtgactacgaagtaccccatgacaattcccggcgtaaaccggaggaacagccccacaatggcaaccgcgataaaatttgcaaccccggtcagataggatagtccaaacagttccaagcagaggcttcccccaaaaatcaggagatagaggacagcgcctttccattttcctgccgagagcagaagcagcagggggatcgccgccagcacgatgatgtaatactgcatgacgccttcatacgagccgcccaaaatgaaaacggctatggtggtcagcaccgccaattttgtgcgaggatctaaaacaatcccactgtggtttttctgactggcaagaagttcgcggctcatgatacaatgcccgcccgttcaaagtgctttttgaaaagtttgcgcccaatcaggccgcccaccagtccgctgacaaaggccgccgccagaagcaccggcaaaatccagtccggcatataggccatgagcgtatctgcatattcctgtccatagccgggaaggagattttgatagtaagcatcccgtgtcacaacaatagggatgaacgcgccgatcacccacatggagaaaacgccgtggatcaggacttcgcgcttggcgtttttgtagccgcagcccttcatcatgaaatcagagatcaatccaaaaatcaggccggtggggatgcaccagtagcccattccggtgagcagcataatgacgccgagcaacaggccgcagatggtcagcataccaaactttttaattttggagaaaaacagcatcatggggatgccgccgaccagcggaacgatcacactgatgagcgggatgaaaatagggataaagccaatagacgccgcggcaaagatcacgataaagtagatcgccgtaaaaataccgatgttgatcaagtctttcccttgaagcctgttcattgagaatcctcctacacataattgattttcggattagacaacgctaaccgtcgtaatagtagcacagatcaaatcacgcttctatgcacataccgacagtttaggcccgaatagcaaggagttttctctttcctgttgtttgatgattgacctctaaaaggggccgccctataataaactcaatcattttgctgcgaaagggggaaaatttgttgcgcgacatgatggaaagtatcctgaaaaacagcgatactgttttgggcgtagagtggaaaagcggcccaaatagcagcgaacttcttttggagcaggaggacggccgcgggaggatggtcttccacccgctctttccgggggtaaccctggcgtttattcaggtaagcgcctcaaattggccggagtccgaggcaaatgccgagctgcggcccctgctgatcaattactgcgttgcaggaagaagtgagcttcttctggatgacggagcctacatatacctgaaggaaaatgattttgccgtcagtgagcagacggcccaggacggctatattttcccaaccaggctctatcagggcattaaaatctattttgatatagagcagctctctcagaacgcccaggaactgatgtccgcctttgagctggattttactctgctgcgtgagaactattgccgcaggcaaaagacctatatcaacgaggcggacagcacacttaccgctattttccgcaaactctgggcactgtcggagcagccgtctctattttatctgcgcatctgcacgctggaactgatttacgaactactccatacggagccgcgcccttcaaaaacctgcggcttttatacggagcttcaggtggggatcgccaaaaaagcagagcaaatcctcaccgcagatctccgaaaacatatccccgtgcgtctgctggcggaaaaattctccgttggggaaaccagtttgaaaaactacttccgtggggtgtacggccagaacatctccacctatctgcgggaggcccgtatgaaagccgccgctgaattcttaacggacaccaaccgccctattgcggaaatcgcggagcaggttggctattccaatcagggaaagtttgcagcagtattcaagaagcaattcggcatgtccccgttggaataccggcgcgcacagaagttggccaccctctaagggaggctcgcactggcgccgtttcccatgaaataggtgcaaacccttaaaaggccgcccgcatccatagggtattggtcggcaatgtctccctgggcgaaatggatgatacccgtgcagcagtccagcagcagttccagatcgtgtgtgatcacatagacggtgacgccttccgcactgagctgccgcaaaacggcggcgacctctttcatgtgccggtaatcaaggccgctggtgggttcgtcaaaaaagagaatagaccgctttgacgcgatagcggatgcgatggccactctctgtttctgtccgccagaaagcgacatggggtgcctgtctctgaacgggaggagatccagccgggccaggatttcctctgcctgttttgtatccggctcctccatgctgatcaacacttcgtccagaactgtttctgtaaagagctgatggtttacctcctgcatgaccatatagcaggtgttcagccgatctttcggacggtatcgcctgccgttccagattacctcgccgcatcgcttctccagcccgcagaagcaccgggaaaaggtggacttgccagccccgttattaccaatgatgcctacaatgcggccggctggaatagtgcaatcctgtatgtgaaggattgccgattcgtggggatacgcaaagcggaactgcttcagctccagttccgtccctgtgcattgcggtgtttgcggcggttgtaattgttccagggcgaaagtgcgcagccccatttccgtccgggcttgctccgacaggccattaaattcctccgcagtatattcccgtttgattttgccgccctccatataaataaaacgatccgctaggccacggagataatagagcctgtgttccgatacgacgatggttttcccttggcctttccagaaagccagggttttccgcaggtcggaaatggacgccgcatccagattggaggatggctcatccagtaccagtacctccggctccatgatcgacacgccggcgcaggcaactttttgtttctctcctccggagaggtggaagatattccggtccatcagcttttccaatcggaaatcacagaccgtcctctccagctgcgcccggattgtttctgccggctggcccagattttcacagccaaaggtgatctcgctggttgtatctacattgaaaaactgggaacgcgggttttggaacacgctgcccacgattttcgccgtatcatagagcggttgttttgacacttcagccccgttgacccacacgccgccgctcatcttcccttcgtaataatgggggatcaggccgttgatcaggcgtgtgatcgtggttttgccgcagccgctttcgccgcagagcacggcaaactcgccgcgcttgatctgaagctcaatgtcccgaacaccaccggtatgctctgtttcttctccataagagaaggtcacatggtcaatctgtatcatcctctgacacctctcccaaaagcgatctgcggctggagcagaaacagagcgaagcaggcggcgcagaacagcgccgccataagatcctgtgcatgaaacccaatccggcacaagttggtacgcctccctggagccccaaggccccgcgttaaggcggcagcggaaagttcatccccgattttgaccacggatacaataagcggtaccagccggtactcgaccatcaggaacggattctttcctccgaagcgtatcccgcgcatcttcatagcgtcccggatggcctgatactcctcgttgacggtgggaaagaagcggaaaatcaccgacagcgggatcacgatcttctccgtcaggtgcatccgctccatggcaccgatgaattcgctcaccgatgtggaggcaatcagataggcgcccatcatgataccgggcgcaaagcgggtcatgatggatgtgaccgccagcaggacaaaggaggggagcccgctcgcccagatcagggccacacgctccagcgcaaagcaggccgcgtacaaaatcaggtactttgccgccgtctgaaagcgtcgctcggagaggatcaggataaatgggacaaggctcaaaagcggctttatcaaattcatgatcccctcgttgctggtactgaacatcagggtggtgatggtcagcaggagaagcagcttggtgcgcgggtccagttggatgcctttcttactttctgttattgtggggtatgacgcgctgctcattacgcaatgcccgccttggcaaagtgcttttttagaagggccttgcccagcagtccaccgaaaatggcgaacacaaagattccggcaattaccaggattatgctccacatcggcatgacagccattacctgatccgcatattcctctccgaagctggccgcaaagctcgcccaggagtcttccaccataaagtacatggggatataggtacccaccatccaaaggctgaacaccgcataccccagcaggctcttcttggcgctcttatagccgccggatttcaaaatcaaatcacccagcagtccaaaaacagcccccagagggacgccccagaagcccatgccggtcaaccccatcagcaggccgctcaaaatgcccataatggtgaccatcccgaactttttcacccttgtcaggaacagcatgaatgggatgccggtgatcagcgcccaaagcgcccccaggacaggaagaaaaatcggcacaaacccgatggggattgcgacacagcagccgatgacaaaatacagtactgtgaacagcccaaggttgatcaaatcttttgcctgaatcttgttgttcataagaaacacctccgcattcattggttagctcattctaaccccgtcatagaataccatacccggactggcgtttctacaactgaacagctttttagctccaatcaacatcgagttttgaattgacgagccagactcttcacgcctataatatagcaaaaagcaattcttttcttgcggagccaagaggaggactcacccatgaacattgatgagattatccgaaaatgcgtcgaagttcccggaatatctatcgaacggggagaatacagcgcggggctttttctaaatgagaaggacggaaaaggctttgtaacattttttccgctattcccgggactgacactggcttatatttcagtaaacgctccgctctggacagcaccggatttgcgaggagagggctctgatgaaaaaggcccgctgcttctgaactactgcgtaactgggcgctgtgagatcattctgaataacggaaattttgtgtatgtgacggatggggatctgtctctgacagaacattttgctcaaaggcagtatgtctatccacgccgcatctacgaggggctggagttcttcgcagagcttgatacgcttgcggcgcagagcgtatggcttctggaggaattcgggcttgactttcactgcgttgtggagcggtactgccggaatggaagcacctacatctccaaggctgtccccgacgcggaagaattgctgaaaaaactatggtcactgtatcatgagcctatgccctttgctgtaatgcagatgaagatctattccctggcgctgttttctctgctgatggagcagacggaaatccctctgtcccaggtctgcgcctattttacggaaacgcaggtgagtattgcaaagcaggtcgaacagattatcacagccgacctgcggcagcatcatccggcctgggaactggccgcgaggttttctatcagtgaaaccagtatgaagaattattttcgcggtgtcttcgggcaaaacatatcggcgtatcttcgggagctccgaatgagaaaagcctcggaattgctgacgggcagccggctttcggtatctgaggtgacggaacaggtcggatacatcaaccagagcaaattcgccgcggcattcaagaagcaattcggcatatccccgttagagtatcggcgcaggaggcacttggagcgccttagccatgagaaactttgacggacagaacacacaaatatctcaagattttacagcatccaacttgcccggctccaaaaatcaatgttataatatccgggaggtggtgtctgtggaattaaactttgaaggcgtagttgttggcgtgatgtcccttgtgatcattggagcgttccatcctctggtgatctggtttgagtatcacttcacgcagagtatctggccagtatttttgatcgcgggcctgctctgcctgatcgccgcgcttttcatccagggccttttctctgtccttctggggctgctgggtgttgcctgcatatggagcatccgggaactgaaggagcaggcccgcagggtggagcggggctggtttccaaaaaatccaaagcggaaataggcagggggcctgcctatttccatcctcttgacagagtgcgtatggttttatataattatcccgcggttagcaatgactaaccgcgaagtacatcctattatgcaagcaaaattatgatagaaaagaggacagattatgttcaatcacctggaatccctgggaacgcaggaaagccccgtcaaagtcgatcttctgcacctggaccctacagacccggacggcggatgctgctgcaggaaaaacaacggcgaacattgctgtgggcggcacagccacacgcaggagcaaacggaacgctaaggccggtgtgattccatgcaaacatcggttatttatggtctgctgatcccttttgtgggcacctcgctggggtccgcctgcgtctttttcctgaagaaaggtttgggggatcgggtgcagcgggggctgaccggcttcgcctccggcgtcatggtggccgcgtcgatctggagcctgctgatccccgccatggatcagtccgccggggcagggacctgggccttcctgccggcggtcattggcttttgggttggtattctctttctgctggggttggatcatctgatccctcacctccaccaaaagagttcccgcgcggaagggccccatacgcagctgcggcgctccaccatgatggtactggcggttaccctccataacatcccggaaggaatggcagtcggtgtggtctatgcgggctatctggccggagacggtcaaatcaccatgatgggcgctctggccttatctctgggcatcgccattcagaacttccccgagggagcgattatctccatgcccctgcgcgcggagggaatgagcaagccctgggctttcgcaggaggcgtactttccggggcggtagaaccgctgggcgccctgctgacgattctggcctcagggctggtggttccggctcttccatatcttctgagttttgccgccggcgctatgatctatgtggtggtggaagaattaatccctgagatgtcccagggagagcactcagatgtgggcgcgctgacctttgctttgggcttcaccctgatgatggcccttgatgtggcactgggatagagactcccgcataacatggaagcggaagggggtacccccttccgcttccgtgtttttcacagtatattaaacctaggattgcttcttgattcgctgaatcgggtcggttgctgttggaagtttattacagtacaggccatagaaatcgtcccgggcgagggtgtccagccacaccgcggaggggcagcagacccgctcgccctcttggctgctgtgcagttgggtgcaggccggaaagaggatcagatccccgttggacacatagaaatcgcacagctcccggcacaagatctcctctgccacccgccgggccgcccactcgggggcagaggtccgcgcgcacagataggacgggatcagcaccggcccctcttggggcgtgcggaggaaggtgctctgcccatccgcccgcagtgcgtagagagagggcaccagggcggtacgggcctgtccctggcgcacagtttgaaatgctccgatgggcatatccgttacaaagctgcggtccagcaggccggaggctgcctcccggccccatgtttcccagacaacctttactaccgtcttgacggcagagttgttgatcccgccgaaggccagcccgtcccagtccggcagccgcatctgctcgcatatccccagctcgcgggtatagtagaccagagggatggccgccgcgggcaggagtttgtcgccccgccgcacggcgtccagagcaggactttcccgcagggagacccaatctgccgccgggtacagctccggttccatcttggaaaaaatggcccgatcctcgaacacctccagatccgccgaaacgatgaggtctgggagcaccgcatccggccgggccagatactccgacatatgctccgggtatcccaagccgaaaaaacgaacctccagctcaatgtcttcccggtgcagccgcccggccagctcctgcaaaaacgccttttcctggcggtgcaggacgcagatgtggttccaatagagcagaatgtgtgtcatgccagatgatctcctctccgaagcgatacctgataggtttgttgccggcggtacagctcgcctaattccatatagagtgcggcctcctgtgggctgcgctccaccactgcagccaccgcgccgccccccatgacgatgcgccgccgggacatcaaggcggtgtgcgggtcatgggtgaccaccagcaccaacttgtcatgacgctgaagcaggcccagcgcccgctctttgtcgatgccggcgttctcaatctcgtcgatgaggacaatggggctgtcgcagagcagggcgatgtcggcgatcatcagcgcccgggactggccgccgctgagctggttcaggctctggcccagggcaacaggctccggggtgatctcattggccagggccagcacctccaccggcggggtctccttccccctgcactgggcatggagggccaggaactcttccaccgaggcgtccagcacgaagcgcatattctgccccaagtgggccaccagttgggaagacaaggactggcggcgttccgccgggatctccacgccgtccaggagcacccggcggcgggtgaccgagtccccatgggccagctgctctacatccttgatgaaccgggacttcccggagccggtgttgcccacgatggtacacagttcgccccgctccagggtgatgccctggaagggttccggcttcccggtcttgtcccggccgggaagaatggtcacagactgcatacttccgcctcctcaaagttgatcttgcccaccacgccctgctggaatgcgctgcccacacgctgctctcccacgcagtaggagcagaccccgctgggcatggtgtgccgcagaatgtccccctcaaagctgccgcacgcaggccggtccagcagccaccgggccaaaaggtcggttccatagcccgccagaccgtccaccggaaaaagcgccgctccggggttgatctgccggatctgccaggagatgatctccagttccgcctgggagaccatgtcgatcttggtgagcaccacaaagtccgcctgggtgagcattgggccaagctgtcccgacgcccggcagctggcggtgcagtccagcacacatccggccgtcatgtgctgcgtggccggggaacagcggtggcaaagtccggcagtctcgatgaccagggtgtcccgcttcaatcggtccgcccagtcccagagctccggcaggttggagacaagaaaatgatccgggcagatgtccccgctcagacccgtcacacagggtagccccatgcgctgaaagagcgccccgtccccggtcttcaggcaatcgatcttgcagacgcagggagcggtgccgccctcttccagcaggggaagcagggccttcagcgccgaggtcttccccacggcggaagccccggaaaacagatagacatggcgcggcacggcagttcctcctcgtattgaaatcggttagccataacttaccacaggaaacacaagtttgtcagtaccaagtgagactccggcaatctcgattgatacttgacggacgcctccgaacccggtaaaatatacgccagaggttagcagtaactaaccagagaggaggggtattttggagcaggtggaactggaacggaggctggcacagtcgcctcttctggcaggggtctccctgccggcggagcaggcgcgcgtccagtcatttccggcgggccatatcctcagcgaccggcccggcggcgtgccctccgtagggctgatcctgtccgggcgggtagaggtctactccgtggccctggacggcaaagatgtccagctcagcacgctccctgccggggagtgcttcggtgtctgcaatctgctggccggcgctgaactggaaacggtcctgcgctgcggggaggaaaccgaagttctttatatccctaaacccgtactgctggcgtgtatggagcgggacgccggattgtccctccggtacgcggagctgtgcaaccaaaagctccagtttctgctccggcgcatcgaactgctcaccatgcagtcctgccgtgggcgggtcatcgcccatctgttggccggtcaggacaggaacgggtgtgtgaagcccaccggctcccgggaggacctcgcacgccagctgggcgtcagccgggcggcgctgttccgggaactggcggcccttcaatccatgggcgtcctgcggtcagagggaaatctcctcaccgtgctggatacgcccgcgctggaaaagctgctctaccacccctcccgcaccaaatgatcaggaaaggaagtaccgtaccaatgaaaaaactgctctctctgttttgcacactgtccctgtctgccgcacttctggccggatgctccggcggaaacggcaacaccaatgcagcggcggatggtgcggagtccacttctccgaccttaacggagccggaaactacgtcccagcaggagacggctgctccggtggatgtcaatgtgatggccctcaaggggcctactgccatgggcatggtggaattcatgagccaggcagacacgggcgaactcaccgacaacaactatcacttcagcatcaccgcggccaccgatgaggtctccgccgctctggcccaagggactacggatcttgctgcggtcccggccaatctggcttccgtcctctataacaacaccgagggcggcgtgcaggtgctggccatcaacaccctgggtgtgctttacatcgtagagagcggcgataccgtccactctgtggaggatctgcggggcaagaccatctacgccagcggaaagggcaatacgccggagtatgccctcaactatgtgctgacccagaacggcattgacccggcctccgatgtgactatcgagtggaagagcgaacaggctgagtgcctgtcggcccttatggcggaggagaacaccatcgccatgctgcctcagcccttcgtcaccaccgctcagacaaagagcgaaaatatccgtgtggcgctggatctgaccgaggagtgggacgagatccaggcggagagcgacgccccctccacgctggtcaccggtgtggtggttggccgcacggtgtttgtagcggagcaccctgaagcggtctccgcgttcctggagcactaccgggcgtcggtggagtatgtgaacgccaatgtggatgaagccgcacagctcgtaggccagtatgagatcgtcgccgcagaagtggcacagaaggccctgccggagtgcaatattgtctttatcgagggtgtggagatgaaggacagcctctccgggtatctttccgtcctgtttgagcagaaccccaaatctgtgggcggtgccctgcccgatgatgccttctactacagccgctgagttttcatgagacgccctcgaaccatacgcgcctgggcggtgctcgtctggcttgccctttggcagctgggcgctatggcgatcgaccagcagatcatcctggtttctccgctgcgggtgctgtcccggctctgggagttgatccccacaccggatttctgggggagcatcgcctactccctggtgcggatcaccgcaggcttccttctgggggtggcggcgggcacagtgctggcggccctctccgcgcggtttcgccgggtggaggagctgctggcccccgccatgctggccatcaagtccatcccggtggcctcgttcatcatcctggccctgatcctgttttcctcccggaatctggcggtacccatctcatttctgatcgtcctgcctgtactctattccaatgtcctgggcggcatccgggctgctgactcacagctgatggagatggcccgtgtattccgcatcccggtggggcggagcatccgctatgtgtatttgccccaggtgatgccctatttcctgtcggcctgcggctccgctctgggcctgtgctggaagtcagggattgccgcggaggtcatcggtatgccggagggctctatcggcgagcagctccagcaggccaaggtctatctggataccccggacctgtttgcctggactctggtgattgtgctggtgagcctggcctttgagcgggcgttcctggcgctgctgcggcggggcgccagagcgatggagaggatgtgagccatggaggacattgtgatccgaaacctgtgcaagtcctttgctggaaagccggtactgcgggatttctccgccgtactcccggtcgggcaggtgaccggcctcatggccccgtccggggcgggcaagaccactttgctgcgtatcctgatggggctggagcggccggacggcggcaccatagacggccttgccggcctgcggctcagcgcggtctttcaggaggaccggctctgtgacaatctggacccgtccgcaaatatccgcctgatcaatccgaccctgggacggagagaaacggaggacgccttggcggcggtggggctggccggctgtctgcggcagccagcccgggaactctccggcggaatgcgccgccgggtggcgatcttgcgggcactgctggcggaatacgacctgctcttcctggatgagccgttcaagggtctggaccgggagaccaaagaaaccgtgatggcggacacacgccggcgctgcgctggacggacagtgctcctggtcacccatgatgttgcggagctggatgccatgggcgcggttgtacggcttgatttgagtacatgagcgcctatccgcaaacagggagaccccgcacctcaaggtgcagggtctccctttgcatttattttcaagacaaatagtacaagaacgaacgaaggcgcgaccgggcagcctcatcccagtcgtgatccatggccaggtggaagtgcggtacgccgtccagcgcaccggtcatctccaagatcgcggtggtattttcatatctgggcgccatggtcagcaccccggcgcaccgtccgcctaactccagccctttagccaaacgatgccggccattggctccggaaaatccgggcagaaggcggtctgcggaggagcgcagagactccagttcaggggaaaaactgctgcgggggcccagcagacggccgagtacttccacgcggcccgcccactcccggcaggccgagcttcccgcatcccgccagaggaaccacagatattcgctcagcggcgcccggagcagccgccagccctcctgttccagtgtatcggggacgccgtcatgaagggtgaagagggtgaacggctcacccacgatcccaagcgtccgtccctccggcggaatggcgccgatgtgcgccgcaagggtttccagctctgcccagcctggcacacccgccggagccagtgcgtcccgctgttccggcggagcgcacagcaggagatctccgacgaggaacgcccggaacagcagatccggctccgggcagcgctccggaagcgtctccagttccggcgcgatgaccttcacgcggcaaagcccctggcgttccaataccgtctccacgccccaggggtattgcccgtctgcctccgcgccctgggtggagggaagaagcacctgaaacgggccgctctccgcttctgccgccgtcaggacgccgcccagcagggccgggaatggcaaatactccttggagctggtctccgccctccccagcggcagggtggtactgtcgagccgcagggtgcgcgtctccgtttcccaggccgcctcacaatatgcgcggagataagcggtaaacggcggaaggtcaggcacgagcagcggccctccggttctctccggcacggcggccaccgcagtagggcggtgtaccacggaggtgagggaaaagcccgccggaagcggctgggcagggcggccctccaggctctgaagaaacgcctcgatccgtgtgatcacgcccacgggagagaaatgctcgtccacctcgatctgcagatagggcttgtctcccatttccttccgaaacagataggaaagcatggtgtccgggccgcagccgtggttggtcagatagacggcatacaggtttggatgatgggccacgagcttggccccggacaggatgtgctgaccaaagggccagtacagattggggtagtcctccgacagatccaggtcgtgggcgggcaagtgggacagggtgatgaccttatgcccgcgctccagcagcagccggggaatacccatgttgagcaccggatcggaaaggccgtagttccgggtaatgagtaccagcaccttgtcgtccggtctgagggacgccagcagttcctgcccctgcttctccaccgccgcggtatgccgccgcaccgccttggccccggatagcagggcgggcagacagcgcggctttggtattcccagctgcttcccgacgcccagcatggcggaggccattgcctcctgtccaaagtccaggtcgaacaccgggctgagcagggtgattccccgccgctccagatccagggcattggccgccagccggggcgcggtctgcatatagacacagccataattgtgctctacatgggaggactcgtgcttcatggtgtggacagagggcatgaagatatagtccacgccctgttccgccagccatgccatgtggccgtggagcagcttcaccgggtaacaggtctccgcctgggcagtctgctgggccagccggatgatctcctcatttgtgggcggagagagcaggacattgaatcccaagttccggaaaaatgcatttgccatggggaagaatttgtggatcaccagcgcataggggacgcccaccatctttttccctgggacccggatggggtcatacccctccagcagcagcgcccccgcccgctggtagaaggcgatgttctccgccacccctggcccggcggcgtgttccgccccggccgctgtgtcaaatccgtggaagcaggacgggccgcggactgactccagcgccagcagggccgctccataggcgccgctgatggggaaacagggtgaaactgtgagccgctcccccaattcctgctgaaaggcggccacgatcccgggattgtaggcaacaccgccctgaagcaccacgcggcttccgacaggcttggccccaacgaccttgtggaggtagttgcggacaatggaccggcacaggccagccgccacctctgcctgggaggcgccccgggagagtgcggactggatggctgtctcgataaacaccgtacaccgctctcccagctccaccgcgctgggcgcgctgagggccagagggccgaactccgccaatgggatacccatgcgcgcggcctgctcttctacaaaggagccggttccggcggcgcagatcctgttcatctgaaagtcggccacctgtccgccccgtagggagatatacttggagtcctgccctccgatctcaaagaccgtatccacatccggcgaccagtggacagccgcccgagcttgggcggtaatctcatcccgcacggcgtctgccccgatgaggcggccaatgcgctcccggccggagccggtgacgcccactgccaggaaggacaccggcccaaagcgttcatggatgacatccaggccccggcgcaccgccccctccgggtccccggctgtgcggagatactggtagtcgatcagcgtaccgtcccggccggtgagcaccagatccgtgctggtggaccccacatcaatccccaggacacacccatccggcgggatggtaccggtggccgcggggacagacggaggtgtaccgggaagtacgcgcagcgccggctgacggcacagccgatccccaccttccagcgccccgccgcataaactggccagcagttcccccatagagcaggtggcggtctccatggctgcctccgcggctcccgcggcgccggcgtaagggaatttctccggcaggatcagctctgcttccgtcaatccgaagacctcccgcacagcctggatcacaccctgattatgcccgatgccgccgcacagggccacgggcttttccacgggaagcccccggacgatcaccgccttgtagttgcgcaccatggcgtagcaaaggcccaggaggatgtccggtgtgggcaccccctcctgctgccggtggatgatgtccgttttggcgaagaccgcgcagcggccggagagccttgggatggagcgggcctgccccaccaggcgggagtagtcctccagtttcagtcccagccgggacatctgatcctcaaagaaggagccggtacctccggcgcagtgttcatttaccgcaaaccggggcggggtgttctgatccaagccggtgaggaagcgggcgctctggctgtcgatttcaatggcggagcgggcttccggggccaacagccggacgccgaggtggatggctgggatctcccccagcacggccagggcatcgcacccctctttcagccggtcgcccgcgtttccggtgatgaccaccgggcagccgcaggcccccgggtccgcggctaaaagcgcccccagcagacggcgggcgctctgaaccaccgctccatagtggaaagccgttttttcccaaaggaactttccctccggggaaagcaggacgagcttcaatgtggcgtttccacaatctaatccgattccgttcatcgtcatcctcccattccgcgctcgttgacatttgccaggcaaagcgctataatgcggttagcatttactaaccatagcagtttacagcacagttgtcgattgccacggcaacatggaggtatctcatgaacccaattactacggtgatgcgtcagtgccgcctgtttgacggcatcccggaagagaaatatcaaaatgtactggcctgccttcggggagaaaccaaattgtttcgtaaggatgccatcctcctccagatcggcgagtgccagaagcggcccggcgttgtgatggatgggacgctgcggatctccctgtatagtgaggacggcaatctggtcaccatcgagcggctggggcgggggcaggtatttggggagactctggtgtgctccatggcggaggacagtcccatccagatcgacgcgctgaccgatgtgcaggtgctctatctggattttgacccgctgcttcttcagcaggaatgcgcttgcccgcacaaagcccaggtcaccgccaacctgctccgtgaaatggggcggagcgccctttttctcaatcagaaaatgcggatcttggcccagaaccggctccgcaaccggatcaagctttatctccagatgctccctgtcaagcccggcggcgaactccatctggacatggggcggggcgaactggccgactatctgtgtgtagaccgcagcgccctctcccgggaactggggcgtatgcagaaagaggggattctcgcctttcagggccaacaggtgcgtattctggatcagagttttctcagcgtataaattttgcctgtccgttgccatggcaacggacaggcttttttgcgggtgctatcatatcgctgcaataggttagctgttgctaaccaaaattctcgaaaggagagtcgcacatgaaacgcgctcttgcatccctggtagcatctgcgatgctgctgtttgccctggctggctgctccaacggaaataatccggccgaaaatcccgccgcatcccccacatccccgccggccagttccacgcaggccgccgagccggtgaccatctcagtgggtgtgcctaccgcgcccccggcgcttcccgtcctgcacatgatggaggccggactgctgggagagaatgtgaccatcgacctgaatgtgtggaactcccccgaggagctgctggccatggttcagggcggggagcacgacctgtacgccttcccgctcactgtggtttccacactctacaacaagggcctggatgtgcgcctgatgaatgtgaatacctggggcgtcacgtatttcatgaccacggatcctgcgtttgaaacctgggccgatctggccggcaagaccgtctatatccccctccagtcctctcctccggacgctctgacccagtatttcctgaatgaagccgggctgacggtgggcgaggatgtggagatcgtctacgccagcaccgcagaggtagccgccctgctggcctccggcgaggcggaatacgccaccctgatcgagccgcaggtcacatctgcgatgagccagaacagcgaagtacgccgggcgctcagctttgaagaggagtggcagcgggtcaccggcaccgacaccatgatccccaacgccggcttcggcaccacccagggcttcattgacgaaaacccggagctgacagagcagttccaggccgcctacgccgagagtgtccagtgggtgctggatcaccccgccgaggccgccgctctggccgaggagcacctgggcatgaaggccgccgtggtggaggccgcgatccccaatatgggcctgaccttcaaaagcgcccaggacgcctggggagaactggatacattctataacctgctcaacgactttgacccctcgatgatcggcggaaaactccccaacgacgggttatactatgcggggtaaggcggccctctggctccgccgcgccctgggcgtgggcctgctgctgggtgtctggcagctggcctcgctctgtttctcccctctggtgctccctcccgttccacaggtcacgggcacgctggcgtggctgatccgggagccggacttctggcccaccgtcggtaccaccctgctgcgcctgacgctcggccttgggatcgggattgcggtgggttccattctgggtctgctgttcggcctgtgccccaaactggaggatgtgggggcgccattcatccatgtgctccagtctgtgccgccggtatgctgggttgtgctggctctggtatggtttgggtttaacggctggccctgtgtattcatcgtggccgcatccaccattccgacggtggtgatcaacctgagccacggcgtgcggggcgtagacccggaacttctggagatggcgaggctctaccgcttttcccgccggaaagtcctgcttcatgtgacgctgccctctatccgcccctatttcctctccgcgttagagatcgtcgtgggcggcggttggaaactggcggtgatgggggaggtcctcaccacgaacagcgggatcggcggcgccatcaccaccgcgcggctgaatatccagcccgatgcgatcatcgcgtgggcattcctgctggtgacagggtgctttattacgcagaagctggtgtgcctgcttctgtccaggagagggggaggcccatgctgagactgagcgggatctgcaagcgctttgaggatctgcccgtactctcaaacctgtccctcaccttgtcccggggcgagatcgtcgccttgatcggcccctccggctgcgggaaaaccacgctgctgaacatcatttccggcctgacggcgccggacgccggtacggtggagggtgtggacggcaggctgagttatatgtttcagagcgcccggctgcttccctggcgcacggtggaggaaaacatccggctggtgcgggaggacgcgcccgccggggaagtgcgctccctcatcgccgctgtggggctggaggggtttgaacgctattatcccagccagctctccggcggcatggcccgccggtgtgccctggcccgggcattccacttcggcggtgagattttcctgatggacgagccatttcaggggctggactacggaatccgcatggagatgctgtccatgctgctgtctatctggcagcgggagcggcccggggtgctttttgtcacacatgagatcgacgaagccctcactgtggcgacccgcatcgccgtgctcactccgcgccccacgacaatctgccagtggtttgacctccccggcccggaggggcgggacgcctccgcccccgaactggcccggctgcgccaagagatcatccggcggatcaccggttagaaccggtctggttgccacggcaatggcgtcccacaaggaaatgtgatatattagcttttagaacacggaaggaggctcggaaatggacattctccgcaatctgccggttcagcagccggcggctctgagggaactcatctccatccagccggggcgcgtggtgagcatggccctttcccgcagcgagcactgccaaatgacgctgctggcttttggggacggagagagcatcagtgaggagcgctacttcggcgacacggtctattatgtgctggagggtgatatgcctctgcgcctggaggggcacgaggtccgcctgggcgcaggggattgtctggctgtcccggcgcagaccacccacgccattggcgggagcggccccttcaaactgctgcaaattaccatccaatcaaactgaggaggatctgtatggaaccgttgatcaaaaacctgccccatgcacggccctttcccctgaaggatcaggtcgggtacgagcccggtaaagtcgtcagcctgaccctggcccagcggcctggtgtggggatgacgctgttcgcctttgatgcgggcgaggccatcagtacccacgccgcccccggggacgccatggccaccatcctggagggcaccgctcagatcaccattgacggtgtcccgcacacgctgaacgccggggaggctgtcatcatgccggccggcatcccccatgcggtccaggccgtaaccccattcaaaatgtacctggtagttgcgaaacagtgaccctttcccgtccaacgctccgtggacaaacccaggcaggggtacgacaaatcacagcataagacacagccccgtctggccttgttcatacggtcagacggggctgtgttcatgcttttgccggcggcagcagactggtcatgctgcgcaggctgatgcccagagtggacaggttatggagcgtggcggaggtggccggtgccaggacgcccaaggcacccaaggcgatgagaccaccgttgaagccgatgacaaagcggtaattggactggatgcggttcatcagggccatggacagccgccgcagctgcaccagctcgaacaggtcgtttgccgcgatggtgatgtccgcgatctcccgggcgatggcggcaccgtcgctgattgcgataccaacattggcagcggacagagccggggaatcgttgaccccgtcgccgatcatgaccaccgtgcggccttgcgaacgctcggcctgcacaaagtgggccttgtcctccggcagcacctcagcccggtactcgtccacccctacctgggcggcgatggccgccgcggtgcgctcactgtcgccggtgagcatgacgatcttgcccactcccaggctgtggagggcagctaccgcatccgcagcctcggcgcgcagcgggtcggagatgcagataaccgcggccagcacgccgccaaccgccagatacagatggctgtactgcttgggcagggtgtcgaaggcggcctgctctcccggcgggacagtgcagccctcatcctcaaagacgaagtgggcgctgccaatgatgacccgcctgccgtctaccgtactggcgatgccgtgggccaccaggtactccacctgggagtgcatctcctcatgggccaaatcccgctccctggcggcctgaaccacggcgttggccatggagtgggggaaatgctcctccaggcaggcggccagccggagcatttccagctccttgttcccaccgaatgggaccacctgagccaccacggggttggcatgggtcagggtacccgtcttgtcaaaaacaatggtatccgcctgggccacagcttccaggtactttccacctttcacggtcacatggaagcggctggcctcgctcatggcggagagaaccgccaggggcatggacagtttcaaagcgcaggagaagtccaccatcagcacggacagggcgcgggtgacattgcgggtgagcagatagaccagcacactccccgccagcgtgtagggtaccagtcgatcagccagatgcgctgcgtgattttccgctgtggacttgagctgctccgactcctcaatcatggccacgatcttgtcatagcggcccttgccggactgctgggtgaccgtaaggacgcactcgccctcctccaccaccgttccggcatagacgctgctcccaggccgcttggggacggggatggactcgccggtgagggacgcctggttgagcatgacctcgccctccgcaatggtgccgtccaggggaatcatgccgcccatgcggatgaccacctgatctccggcctgtacctggtggagcgggaccagttcctctccgctttcggttttcatccagacccggtcgatattcagggacatgctcctggccaagttttccacggactttttgtgggtccactcctccagaagctcgcccagccgcagcaggaacatcacggaactggccgtgtcgaagtcccgccgtaccatggacaggcagacggagattccatccaacaactccacatggagctgtctccgcagcagacaccgaagcgcccggaacagataaggagccgaccgaataactgtgtagaccgcacgaagcggagccgggaagaacagggatcggacggccttaaacgccaccatacccaccagtttttcctcataggcacggttgagcgcccggctgctgtggaccgggaccagctccgccagcgcatgatcctgataggagaagccagcgagaatcctcagtaaatccttccgatccccctgatactcgatcactgcgcaacgagttctttcatggacagacgcacactccacctgcggcagagtcagcagccacgcctccagcatatcggcctgctccagcgtcatgcgctgctgcacagcctgaacacggattcgcccgcggcattcgtgtttgatttgaaatttcatgattgcctccacagaacaagagggaccgcccccggcggcccctctctcatttcttgcgcgttacgcttcagagcactccacgctggtggcctcctccgctttcgcacgctgctcgttgatctccttggcggaagccaggatgtcagcagcattctcctgaacggaagtgaccgtttccatcacggactcctgcacacgcagtgcggctgcggtcatgtgggtataggccttcttcgcatccttgctggacagcagcttgaagccggcagagccgaacagcaccccgcccacaaacagggcggctcctttatggaaattcatcattatggtgttcacctcacattcagcggtgccggtacccggtaatgaaagtcatgaccatgcagataacagcgccccaggcccagaaacggtggtgcttcattggatagtccctccctcgccagacatggcaccttatttcggtcgcttataataacataagaatttgaggtttttctatctgttctggtcaggaaccgttgtaaatggatttttatttgcgttccggcggaattgggcgggcggcatatggtaacgccgcttaaaggcgattccaaattggctgacgctggaatagcccaccaccgtggagatctggagtacggactgggtcgtagtcgtgaggagctccgcggcccgggccatgcgctgctccagaagatactggtggactgggaccccataaacctggcggaaacaggacttcaacgctgtgccggaaattcggaactgctgagacaggctccgaactgtcaaccgctcgtccaggtgtcccaccatgtatttctggatctcgcgtatggtctcgatctggctttgggtatggtaatcgcactgcggtgtcagggccagcccctcccgctgcgcgtggagcaggaacaggacttccagcgccttgataacatagtagtccccgatatgtcccagctgcatatagtccaaggcagaaaacagagcttcgctccagagtgccgctctcaacatacagggatcattccaggcgcgggagatggactctcccaggtcggagtgcatggcacgcagggtcgaccatgcggttttcgcttccatccgaacaagggtgccgtagaatggctctgaagcaaaccgtccccggtacgcttctgtgcggaccgggagaaacagcacctgatcggtgctgaggctaagacgccggtggccggcccattccaaaaaaagctcgcctttgcggcagaataggatctccagcgcctcagactcctgaataaacaggaactcttccgaggggggtaccccttccagccggaagatagccgcctgctccgcgggcaactgggtaacggtccagccgtcccaggataaaagtgcgtccagcatggcgcttactttcggaaggagaacaggcccttcttctcataaggggctgactggatggaaaggacctgatagcctgtggcggagatcgcaccgcgcagggcgtcctcgtccaatctattctcacacagaatctgcgtctgccctttgctgtgagacgaggtgacctttttaacgggaaatgccttgcggatcgcgtcgttgacatgggcttcacacatagagcaggccattccttccaccacgatggtatattggagcataacagtttcctcctcattttgttagttttagctaacctctcagcaaaatgaaacgccaaagaaacagttttcaggtaccttcgcgtatctgaactcctgattttggcgcccagaagttagttcttgctaacccaataatagcataaatctcaagattctgcaagtcttttggtgggcgaagcaatcataagtgtgcgttttacagccaatctatcctggcaaaaagcgcaactgttcaagagatgaaaaaggtggtatgctctacttgtatttaggtcagattttgtaggtcagatttttacccgcgaggggccaatgcgccccgagcggagacttgtcagaacctaaataccggaccgaccacgcacaaaaaccgcagttgccccattcaggggtggctgcggctttttttgtgcatcaaacacagaaaggagacagaccatgaatgagcacaagcaaactgatgaaggtcacctactacgaccccaaaagccaaatccgcctcctctgctacgccgacaccgtagtatgggacaccaaacccacgccgacccttaccgctttgcggtttggcggctacccggagcgtgtgcagggactcgcagacgcaatttatggcggggctaccatcgaaatcgaggacggtaaagacacctactccttgaaaaccctcaccaggcagtaccgccgggaacttagccatgacggagtgtacgcagaggctaccctgatcgcagaggatgacggccaatccgccaaacagaatgccggcgacaaggatgagccggacaaggacaagaacgacgaggacgacgatcaaatccagcaggatctcccgccgcgcaatacctacattttctgcacaccgggggaacgccgggagttgttcgacgcggtggaccaaaagaccgccgttcccatgatcccggagtaccaggattatgtcctcacggaactgcaaaagaggaatatcctgcggccacttcaggtcaagtccctgtcccgtaagctggaggcgtggcttctgcgctgtgaggagaaggacaaaaacatcgtcgcggtcatggaggatggactcaaaagcggagcgatctccattccgggtgcgaccgtcggcctaaacccgctggacgaaatcaactctatcacggaatacctcaataccttcggcgttaccgtggcggagcggatcaagaagctgttcgtaccgctctttgaccctgcaacggaatctctgtccccggaagtgctggcaatcaaccagtacattgaggatcacgccggctatcccctctacgacgcccagcttgcggtggcagaggccatcaagcgccagctggagcggagcaaggtggggctcattgtggcagaatgcggctctggaaaatctaagattggagcggtatccatctccgcaacggctgcgggacttctttcccaccagatgtccgtcaaggtgagcaagacttttaacctgatcctgtgcccctcccatgtaaccgagaaatgggtgcgtgaactggaggagaccgtatggagctgtgctgcggcgacggaagcgggggtacggagagatgaagaaaaagaagatcaccttttctgagcccaactgccgtttcggctgcccgcatttcaagagcgtcgggtctgtgctgaacgaaacctgctactgcatgaaaaagggcaaaaagggcaggcgtttggggaagaaagacctgaaacgcagacctcccgaatggtgcccccgccgcctgaaaacacccgtctgccgtatctacggcttcaaggacgagatgcacgaggccctggagctggataaccggctgaactttgagccggacaaacacgattggtattttccatcgtcccaccactaccagctccagagcgagtttccactgggcatgactgctgagcagttttacaacgcgctccaggaggagccggtggagagtgtgctcaacggcacgccgctgaaaaatggcgaattgatcgaaattgacgacggcctggcttctcatttcttctactgttatagccagagtaccgtccttccggcaaaggtgttcggcctcgaacatgagggaggcgcgcaccatgcctgagcacaccgccgctccaagtgagcagacagcacccatgcggcttgctaaaatcctggatagctttatcccggggatgcacgacactccctgcagaatcgctatctttaccgatggccgcaaaatcaaagtatttgaaaaggtctatttccgcaggccggcgttcgatcccccgcttccgcagacctgggaacgaaactactggctggagcggtatcagactccgcaggcggtggaaaaccatctgcaaaaaaatggactgttaaaggagaatagccatgaatgagcatcgaaactgcacttgtcccgcctcaaagagcgggagtttccagatcgccacagaccattacagccgcaacttcattcctacgggctggaagctggagtacacctctcttgaacagcacgagccacagcggtttctgtatatgaccggctggtgcctgcgctgtggtgggcaggacctgcaaagcggcatatctatcccggatgagctttccggtgacgctctcctggagcgtatctatcgggagatggaacactacatagctgatttcacccatgagctgtccaaatgggatgctgcgaatatcctgcccgccaaagtggaccgtaccggaggttacatcccaaaaaccggccatcagcttggcaatcgtagacttcccggagccggatggaccaactatggcggtcatggtaccgggctgtgtctggaatgagataccgtggagaatttcggcttcgttataagcaaaatggacatcctcaaattgataacaccgctccccaagctctgcgggctctgtggggcggacaagttccggtgttttcaaaaaggcggtgacctgttccagattgcccttaatcatgctgacctgctccatggcttcggataccttcatcagaggcgcaatgaaccccagaggcaccaccaaggccaccagaaagacatggagggaaagacttccctccatgtagagccacgctcccactggaagggtccccagaagcgtagaagggaggaccgcccgggccgccgcgttccaaagccagcactggctccaccatgccatggtggaatcgtggaaatagcggacagaatcagcatactttccataggaagctgcggaccggttgaacgccttaatgacctgaatgccgttgacatactccaccagagcactgttcatctcgttggcagagcgcatatagttctccatgcggggcccatatccccgcatcatggcggcaaaaaagagggtgcccagcggaattgtcaccagtgcggccagccccatccgccagtccagcagaaaaatcagaagaatactgcataggggcgcggcgatgttagagggcagttccggcatgaaatgggccatggagtcctccagcttcgccacattgtccacaatcagatttttgaaagctcctgtgggcgtttccagcatgacgcccatggggatcttcgccatccgacctgtaatggcctcccggatatttttcagtatggtaaaggaaattttgtgggacatcagggaggaccgccaggtaagcagcatttttatgatctggcaaactgcggcgcctccgcagagaaacaataccagcttgggcgttgcagtcccccggtacaaggcgtccgcgaggacagccaccattaaaaacgggcctatgccaaacagttctcccaagacagccaggaagatggagaggagcattttaccgttgttttctcccacgaaagcaaagagctgccgaatcgttcccggttctttcgacttcataaccagcctcctttcaggccacaaaaaatgcaaggagggtattgcaatttcaagggtcctgtgctaaaatttgaattacgatgtaatattacagtgtaattttagtataggacggagggacagcgaatgtcaagagactttcagcagacacacgaaaatcttttgttctgcgcccaaaaacactttctggaatacggttttgagcgggccagcatccgggagatctgcaaggacgcccatgtgaccaatggagctttttataaccactttgacgataaggaagccctgttcggcgcgctggtggagtctgttgtccaggaggtcaaggccatctatgaggcgtcagtaaatgagcacatggaactggcaaagacggatgacttgaaatccctctggaaactgtcggaggaaacgctgtcggtcattatcgaatacatctatgagcattttgatgtattccggctgcttctcatgcgggcggagggcacgcggtattcctcctttttggatgatgttgtctgtctggaaacccgggtcacgctgaagttctttgcggaattgaaatctcggggcttccaggtccgcgaattggcggaagaggagtggcatattctgctccatgcgtattttgcatctctggctgaagtggtcatgcacaacttccccaaggaggccgcgctgaaatatgttcatacgcttgtctcttttttcaactccggatggcagacagttttggggatctgatccccaaaatttttgcgcaatagttagcatctactaaccaaatgatgtggaggtgaaaccgcagcgtcccctttgcacggggttttgcaacacttaattcttttcagaaaggacatattaaaaatggaaaacacaaagaagctcacaggtaaagacctaatcaatgtcggcatttacacagccatgaccctcgttattttctttgttgtcggcctgcttactgcgctgccggtggtttacccgttcctgttcataatttggcctatcgtctgcggcattcctatgatgctctactataccaagattcagaagtttggtatgctgaccatcacaggtatcatcggcggcatctttttctatctgatcggctatggctggatcggcctgctcggctgggtactcggtggcattctaagcgatgtcgtgctcaaaatcggcggctatcagaaattcaaggccactgttctgagctatgcctgcttttgccttggcatcatgggctgccccgccaatctctggtttgccggcgaagcgtattgggaaaacatccacacctccatgggcgatcagtacgcaaacactttacaatccctgatgccctcctggatgctgtatgtgggctttgcgctgctgtttgtgggcggtattttgggtgcgctgctgggtcataaaatgctgaaaaaacactttgagagagctggaattgtgtaatggagcagtttcaagcggttgttgaaaacagaacaggcttttgcttggacccacgaaccaagctgctgctgatggccgttgtcgctaccgcggaatttctatacagccacaccgcctttatgatcgcggtggcgatgattcccttcgtcctgttgttgactaaccggcagtataagacggcaacggtgttcttctgcctgttcgcggcggggctgtttgtacaggccatccagaactccgtccagtttcccatgatcgtcaatatgctggtagtcctgttggtgggactggtcctgcggctctttccggcctttgtgatgggggcctacatcatcaaatccaccacggccagcgagtgcattaccgcgctgggccggatgcacattgggcggcagatcaccattccgctctccgtcctgtttcgctttatccctaccatgcaggaggagtcggccgccatcaaggacgccatgcggatgcgggaggtccagttcgggacaaagaaattctggcaaaaccccgccgccctgattgaataccgttttattcccctgatgatctcggtggtcaaaatcggggatgatctctccgcggcggccctgacccgcggcttggataacccggtccggcgcaccaatatcacaaaggtcggttttactggctgggatctgctggcggtgctgattgccggagccgcactgctctccacatactttttcagtccgtggtaaggaggtgataccgtgatcgaattgaaagatgtttcctttacttatgagagcggagaaacccaaaataacctgaaccatatcaatctgacaatccaggatggcgaaaccatcctgctctgcggagagtccggctgcggcaagacgacgctgacccggctggtcaacggtctgatcccgcattattacggcgggaagctgaccgggcaagtccttttagacgggaaagagttaaaagactatcctctttatcaaatcgggcaacgggtggggtctgtattccaaaacccaaggactcaattctacaatgtagatacgaccagcgagatcgtttttggttgtgaaaacatggccctgccagtcccggagatgcgggagcgcctggaagagactgcccacagcctcaagctggaaaagctgctgaacaggagcttgtttgctctgtccggcggagaaaaacagaaaatcgcctgtgcctctgccgacgcaatccacccggacatctttgtactggacgagccatcctccaacctggatattgccactatcgaagatttgattggtgtgattcggcactggcagtccgagaaaaagactgtgattgtcgcggaacaccggctttattatctcgttccctacgcagatcgaattctttatatgaagcacggaagtattgtacgggaatttgccgggacggagtttcaaaaattatcgcccgatgaattgcaggggatggggctgcgggcactggacccattccacctgcccccagaggccgcccccaaaccggccgctccgaaattacatatcaaggggttccagttctcctatgaaaagcacggccccctcaatgtggatattccagacctgaccctgcctcaaggcgagatcattggcatcatcggaaacaacggcgcgggaaaatctacctttgcccggtgtctgtgcggtctggataaaaaagcaaaaggtgtgcttgaaatggatgggaccccctatgacgcgaagcaacgcaggcatatctcctatatggtaatgcaggatgtaaaccaccagctatttacggaagatgtgctggacgaattgctgctcagtatgggcggtgaggacgagaaagctgacacggcccgcgccaaggagatactgaacagcctggacctgttggacaaagtaaagctgcaccccatgtccctgtccggcggtgaaaaacagagggtggcgattggcagtgcaatagcctcggacaaaaagatcctgatatttgacgagcctaccagtggattggattaccggcatatgctggaggtgtcggacaacttaaaccgcttgaaagagatgggaaagagcctgtttctgatcacgcatgacccggaactcatttataaatgctgcacctacctgttgttcattcaggggagcaaggtgctgtggcatcggccaatggatggggaagctgtgaagctcttgcgggctttcttctcccacgagcaagaaacaggtgcggtcaatgcctcctgataaaaaactgcacgcttccggcgaggattatttggaggccgtgctggtgctccaaaaggaaaaaggaatggtacgctccgtgggtgtggcccggtatatggaggtgtccaagcccagcgtgtgccatgcggtggcaacactaaaggacggtggcttcctcaccatggacgaggacttttccctgcgcttgaccgatataggccgagaggtggctgagcagacctatgagaagcactgttttttcacccgccggcttatcgcggctggtgtcgatccccagactgcggaacgggaggcttgccggatggagcacaccatcagccagcggtcctttgaattgttaaaaggggcggtggagccggaatgaccggtaagcagtcagaagaaagggaggaccccgcgtggggaaattgctgattttatccgtcaccaatggcgaggaacaaattctggataggatcaaggacttcctggcggaagagcctggaatcgaggtcgtggagccgcccgccgcaaagcacaccctcaccattcccggcctggagctgcacctgcgcaagcagacggtaaagtggcagggccagcctctccaccttacgcacctggagttcttcacgctggcttatctggcccggcaccccggctggatttttacacaggagcagatttacgaggccgtatggcacgagttcccggaggactgcggcgcggccgtggtcaacatcatcagccagctccgccggaagatgggaccgggaaacccgatccgtaccgtcccccacagcggctacaagttcgagctgccttctgcggattaggtgcgcgggaaagagtaagttcaacaatctatgcagattgattgccatttacctgaaagaaaatgagcagagggtacgggcttgtaagtatcatttatttctgttatcatgtcagtgtgaacaaatagggatcgccgtaattccggcggtccctattcctatgtccacgggctatcgtttcgttagaataattgcccaaaacttggaaataatgattgcaaggcggtgaggtcatggcagaaaaacatcaggttgataaaagcatcgacgaactggttgatattcgtgatgtaaagctggatagcagcttgggacaagcggaacgcatccagtcatttcttcagcaaatcaaaaatccctactgcttcagagtgggagatgttgttgtcaatgtggcctatacagagggtggtccaaccctaaacgactgctttgctgatatgctgtcgctcctgtgaggatttacctgaaaatgcggctggacttttttgacccgctgtggtaaactgagcatggacaaaatcagtgaaactccagtcgtcatgatggcctggccgtcaatatctcgacaggagcggtagctatgctaaatgcagatatgatttatgaagccgccgactaccttagactttctaaggaagatggcgacttttctttatccaatgataagctggagagcgacagtatttccagccaacgggctataatcgaacgatttgtcgctcaaaatccgaatatcaagctggtagcggagttttgtgatgacggttataccggaacaaattttgatcgtccggacttccagagaatgatggaagctgttaaggccggtaaaatcaactgtgttatcgtgaaagacctttctcggtttggtcgtgactacattgacgcaggaaaatacattgagaagatttttcctcagctcggtgtacgctttatcgcagtcaacgacaactacgacagcttaaatcattccaccggggacagccttgttctgcccgtaaaaaatttcctgaatgactcatacagcagagacatctccatcaaggtgcggagtagttttgaaagccgtcgccaagacggcgagttcattgccaattatacagcttacggttatctgcgcgacccggaaaataaaaataagctggttatagacgaggtggccggtgaatatgtgcgcgagatctttcagtggaagattgagggcatgagccctgtcaccattgctgagaagctgaacggccgcggggtcctgccaccgtcagagtataaacgctccattgggatcaaatacaaaaccgcctttcagaccagtagccggagcaaatggagtccgaaagcggtgatccgtattctgaccaacgagctctacacgggtgttctgatccaaggccgccgcacaactccaaactataaagtaaaaaaagttatcatcaaggacaagagtgagtggagccgtatcgagaacgctcatgaggcgattatcccagcccgggagttccaattagtgcagcggctgatgcaggaggatggccgtcgggcaccaggctccgatacggtatatcctctgtccgggcgtgtcttctgcgggacttgcggcgcactggcaaagcggaaatccgtctcttataacgggaaaaaatatgcctactacgcctgtcccacagcgaaaaaaacgggaggatgtgaggggcggaacatttcggagcgagagctggaaacggctgtccttactacacttcaatctgagatcaaactgattttggatgtagaccgggctctggggcaggttgaagcattggcctgggagcgtcgggagattatgcgtctggaagcggctatttctgcacaggaagctgaaattgccaaatatagaacgctgaaaaccagcgtttacgaggatcttcgagacgggctgatcacccaagatgagtttctacacatgaagcaggacttttctgaaaggatttctttcatcgaagatgatatttcgggtttgaaaacagagctggatgccgtccgagctggtcttgtcaaccagacggggtggctggctcaattccgtcaatatcgaaatcttgccaagctcactcgcacggtggtcgtcaatctgattgacaaaatccacatttatcccgataaaaagattaccgtcaccttgctttgcaaggaccaactgaccgatgtgattgcgttcctgcgggaacaggtgcagacacagcacgccgctgaaaaggaggcgggttgagcatggccaggaagaaaagagtccacgcatcccccatgcgcccggagatccaaggggctttatgggtcgccgggctttatggccgcctatccgtgctggacaacggcaaagtggatggggagccgattgaaagccagatcgccatcatagagcagtatgtcgccggtcatccggaattgaagatcgtagagcggtatatcgacaacggttatactgggacaaattttgatcgtccgaactgggagcgaatgatggcggatgttaagtccgggcggattaactgcattatcgtcaaggacctttcccgcttgggccgcaactatattgagacgggccgttttttggaacggatttgtccaaagctgggtatccgcttcatctcggtgaacgataactatgatacggcggagatcaaatcacaggacgaatttgccgcgtctctgaaaaatatcgtaaatgactactatgcaaaagatatttccctgaaatctggcagcgccttaaaagccaaacggcaaagaggagaatatatcggtagctatgcccctcacggctatctgaaagacccctcaaacaaaaaccacctgattatcaaccctgaaaccgcgccggtcatccagcagatttatcaatggcgcgccgaagggctcggatacgggacaatcacacgaatgctcaatgagcgtggtattccatcgccgggccgctatcggtttgaacacgggattgttaccaataacaacaaaaaaggcagctctcttctgtggaatcgccatgcactcaccgatattctccgcaacattgtctatatcggacacttggctcaaggaaaatgtacggcaagtctggcccgcggcatacccgtccatcgcacaccggagtctgaatgggatattgcctaccatacgcatgatccgattattaccgaggagcttttcaatcaggtacaagaaatcaaccgttcgcgggcagatgcctataatgccaattatggagcctgcagccacctccccaagggtgataacccctatcgggaaagactggtctgtgcggactgcgggacacaaatgaagctatatcgcaatctaagcaaaaaccataaaaaggcctacttcacttatatctgccccacctacgaggaacatcaggaactgcgatgcaccaaaaagacgatacgcagtaacgctttagatgccatggtgttaaagacactgaaaatacagatggagctcttttgcgatgcgcaacaagtgctggagcggctatcaaagaaacaaccgaagttccctgcccataccgaagaaaatgaattgcagcagctcgaacagcaagttaagcggaaacaagggtatgcgacatcgctttatgccgattatcggacggggcttctgacgcgggaggaatacacatttgcccgtggcaaataccaggaagaagtagctgccttacaggggcggatcagccagctccaagagcggcttacccttacaagccaagtgtcggattgtgctaaaagctggatggctctgattgaacaatacaaaagtgctgaaatcgtgtccagagaattggtcacagcatttatcagtgagatccggctgtccgctgacggctccatcaaagtctcgttcttgttccaggatgaattatctcgcatccgggcgcactgcaaggctgtggaaagcgaggtggcatagcatgacggatacgcctgccgcttacctgcggacttccctggaggactttaaccgtgctcatggccttgccgaccaaagccagtctattagcaaccagcggaaggtaattttagaatatgttcagcataatccagagttttctgaagttcaaatcagagagttcatcgacgatgggctgacaggtaccaacacggaccggccgcagtttcaggcgatgatcgaagctgcacggcgcggtgaggtcaagtgtatcatcgtcaaagacctttctcgatttggcagaaactatctggatgtgggcgactatctggagcacatcttcccctttttgggggtcagggtcatcgcggtcaacgatggctatgacagcaaacagtatgagggcaaaaccggcgggatggatattgcctttcgcaatttcatgtacgaaaattacagccgagatctttccatcaaggtccgttccgcaatgcactcccgcatgaaaaaggggcggtttgtcaatcatgttccctacggttatcaaaaagccccgggtgacaagcatttaatggtgcctgatccaaacacagcccccattgtccgcgagattttccaatcaatcatcaggggcaaaagcacctctcaaatcgcaaaggaattgaacacccgcggtgtgcttacgccactggcctataaacagcaccgtttgaagccagcgtgccaaaatcgggagttgatgtggtcgcatatcactgtgctgaacatcttaaaaaacgataaatataccggggtgatgaccaatcacacacgagagagccggtatatgcgcgacaaaaaccagcgccgggtcccccgcgaagaatggatcatcaccgaaaatacgcacgaagcccttgtaacgaaagaagaatttgacgccgcccacgccatgataagggaggtaaaaagacccgagcgaaaatctccccccgcctgtgatacagtgttctattgcgggcattgtggcaggaaattgaggaagtctcatggccttgatacctatttcgcgtgtgacacccagttataccaggaaaacgccacctgctcaaatatccgatggagcaaaacagatttagaggccgtcatgctgccggtctataaggcccagttgtatttgctcggagagcgggcaaaagagctggcgcttcaaggcgacggccacccaaatgaaaactggccagagatggtaggaaaaattgatcgtgagattgccgcttgccaagcgcaaaaagtccaatactacgaagcataccgcaacggcgacttagatcggggggcttttgtagaacaaaaggccgccctggccataagaattgaacacctccaaggcgagcgcacggaaattgaactgaagcgccaggcacaacggacacagattgaggcgcgagagtctgccaagcgggagctgtcccaatacctttatgccacacatctggatggggcgctcctgacggagagtatgtaccaagcgattgaccgcgtaaaagtttttagcaatgagcgtattgaaatccgatggaagtttgaagacctgtttgcgggacaaggttaccgagaaaggaaagctgtatgagggtcgcattatatatacgaattgcaaacgacaacaccggggatgcgatttcgtatcaagagcaggaattgaggcgctggtcaaacgagcacgggcatgaggttgtagaggttttcaaggataatgccccaggagttcttgcggaatgttttgaacttcaaaggctgctcgcccagctggatgctcacacctttgatggcgttgtcgttcgtggattgaataggctggcgaggagctattacgatttcccacagcttgctgataagtttcagaaagccggagttaaaatcatcgtcccctatgataccgacgatgcctttgcggagtgtgagacgggtttccatattttgaatgcgctaaaggcaacctgggaacgcgcatgaaggtagcgcaaaaatcaagcaggaagcagcggtgcagcgcaccaaaaattttatgttttacttgacacattaggacgatctcgggcgcgtggtcattcccaaggaaatccgcagaaccatgcgtatccgcgagggcgaccccctggagatctataccgacaaggacggcggcgtcatcttcaaaaagtattccctgatgggcggcctgggcgacttcgccggccagatgtgcgagactctgaacaagaccaccggcgagatcgccgtgatcaccgaccgggatgcctgcatcgccgtggcgggcctggcccgccgggagctgacggacaagcggatctcctctgagctggagcagattatggagggccgccagatttatcagtaccaggcaggcgacaaggcggtgcctgtaagcgacgacgggagcaagtatcttgtggcctgcgccgcccccattctatccgagggcgatgtactgggctgtgtgctctttgtgggcacggagggcgaattggccagcagtgaaaccgactataagctggcccagaccatcgccgggttcctgggccggcacatggaatcctgattccaatgatgatagggggcatccctgttcggatgccccctatcattccaaaaaggccgcatacaggaggcccctgccgctggcaggggcctcctgtgcgtattcacctaaccgcccagggtcatgccgccgccggagaggccgtccttctccagcatgcgctccagcacctgcacgtcggtggcgatatccatggcgtcgtcctggaagagcttgtcaagctgcttctcgaagccctccaccaccttgtccatcatgccctcgatgcgggccttagccgagcggatattctctccctccacgccctgctcctccatacgggcgtaggcccggaggattttgagggtcgtaggcagatagtagcttaaaaagctgcgcaactggcccgcccggttggggctctgcttctgataggcaaagatcttgccggtgatctctccgatgcggtcgatcttctggctcatgaccggatcgtcgatatcgtcgttgagtcggcggatttcccccagcaccgcgtcatcgtcgttcatgtccagcacgtcctcctccggctccggctcgtcgggctcgggggcagggggcgcctcttcctgaaggccctcgtcactgaggatcagacggccggtggacatatccagatagcccgtctctaaaataccgctgtccagcatatcctggagatcgtcacaggccttgtgcaccgacaccggcatggcctgggccagggtggtgatggagatgctctcccgcctgccgatgagggccaggtacttgcggaagcgcttggccttcttagtgcgctgggtacccgcccagatcatggccaggccgccgccgaagaagccgatcaccggggacatcaccgccaaggcggagaggaagccgccgctcatggccaccgccgggaatccggtgagtgcgatgccgaagatcacggtcaacacaattccccatacggtcaggcccttgccccggtccaggttcaccggcctgccctgccgggggctgcggcccacatgctgccgccccaccggaggcgtctgccgctgggcgccgggcattccctgcgtgccggggacagggcctccctcccgctggatatcataagggtggcgggaggctctgcgcctggaacctccggtcagctttcggagcagcagaataaggccgatgggccagaccgggctgaccagcaatacgatggtaatgatccaggagagcaggtcccccgaatccggtcgattttcatttcgatagcttgccatgggcaccgccctcctgttactgccgcgtgttctgtctgttattctatcacagaagtgttaaagtttcgctggataagttctttaaaaaagatgaaagattagattgcgccccgctgaagcctctctatcatactgcgaaatccggggcatgtaaagcgctttccgccggaagtgctatgtaaccgttctgtaattgcttttcccgggacgaagtcctataatagtagtcgtattttacatcctctgtgatgttttggagttgatgaagatggaaaatcaggatggaaagagggtcgcaaggggaccgggcatgccccggggcggaaaaatcgctctggccgttgtcctcgttctggtcctggcactggcgggtggatatgtggggctttgcgcctatgcgggcagcagtgctttcctgcccaacacctccattgccggggtggacgtgagcggccagtcccgggaaggggctgccgccgccctggagggcgccctgcccggcctgctggcggacagccgggccgaattcacctgtgcgggccaaagctatgcggtgaacggtgacgatccctctgtctccgtggacgccgccgccgcagtggacgccgctctgaccgaccaggccggcagctttttcacccggggcgggcggtatctcgccgccgtgatgcacggcaaccgctactccgtccccgtgaccatcaccggcacgccggacgcggtaacccgggcggtggaggagtgctccgacccggaggcccagaccacctgggaggtcaccgacaccgagctggtgctccacaagggggtcaccggccgcaccattgacgtagccgccctcaccgatgccctggccgagcggctgggccatctggtgtccaatgacgagtcggcctcctatgcccccatcgaggcccaggtgaccaccgcgccccccgccgcccccgactttgacgccatccggtccgaggtcgccgccgagcccgccgatgcctacttagacaaggagacgcgtgagatcgtcccctcggtcaccggagtggacttcgacacggcccaggcccaggctgtgctggatgcggccggggagggagagacggtgtccgtccccctgctcctcaccgaaccggaactgaccaccgccaagctggaggccaatcttttcaaggatgtgctgggcagcggctccaccacctgcgccggcccctccaaccgctggtacaacatcgatctggcggccaagcggctcaacggcaccatcctgctccccggagagaccttctcctataacgacacggtgggcccctacaccctggccagcggctacaaggccgccggcacctaccagaacggccagagcgtggacgccaccgccggcggcatctgccagctctcgtccaacctctactgggttaccctcaaggccaatctggagattgtggagcgccacaagcaccagttcaacggcggctatatgcccgtcatcggcaccgacgccaccgtgtggagcgaccagttggacttccgcttccagaataacaccgattaccccatcaagattgagtcctatctggacaaaaaccacaagctccatgtgaccatctacggcaccgataccaccggcatccacggagagccctaccacgtggtcatttccaccgtgccctacaagaacacctaccagcccaaggacagcattcccgtgggcactgagccccagcgggaccccaactactcccgctacaacggctatacggtagatctctatcagaagctggtggacaagaacggcaagaccatcagcaccaccctgctgtaccgcaacacctacaaggcgtccgacgcggtgtactactacaaccccgctgacgcggcccgctgggggattgacccctccaccggtctgaaaacccttacgccggtcacccccaccccatcgccgtcccccagcccctcccctgcgcccagtccgacgccaggcggcactccgtcgcccgtcccaaccgccacacctgtgcttcccctggagcccagtccaactgtcccccccagcccggagtccccgccggcatatacccctcctgtggaggccaccgccacaccggaatctggcgtcggtcccggcatggagccggtggaggagaccccggccgtcacgccggaaaccgggtccaccccggcggccgtaccctcagcggcgcccgccgcctgaccctaaaacaagagtggaggcccaaagggcctccactgagactgtcgataacccctccaacgaaaggattcggaggggaggatagtgtgaaagggaaccgtcagggttccctttcacgttggatcaaacgactttttggaacttttccgaagtttcaaaaagttcggcagcctgtcgaaaagaccttttcgacaggctgagcggaggcccaaagggcctccgctcttatagagagaaagaaggttctttatgtttcaaggcttttccggcgccaccgtggacttcatgtggggcatccggttcaacaacgaaaagggctggttcgaggcccacaaggaggagtacctgaccacctttcagcggcccatgaaggcgctggccgacgaggtgtacggggcctttaccgaccgccatcccgacctggacctcatctgcaaggtgtcccgcatctaccgggacgcccggcggctcttcggccgcggcccctacaaggaccatctgtggctgagcctgacccgcccccacgaggagggctgcgccgagccggtgttctggttcgagctgggcccggagggctactcctacggcatgggcttttggcaggctccggccgtcaccatggccaagttccgcgcccgcatggaccgggagcccaaggccatggaaaagctggcccgccgcttccagaagcaggacgtatttgtgctggagggggaggactacaagcgccccaaggccgccccctcccggctgctcaccccctggtacagcaaaaagagcttcgccctctcccacgacgccccccacggtgagccgctctggtcccacgatctggtggatctcctgctggaggggtacgagttcctgctcccctactatgaatacatgctctccctcagcggtgaccccgatccccgggcacaataacagaatttacatcgcaagcaatcccgccagcagcgcatactaaggccaaaggattttggaaaggcggcgggcgggatggagcgaacttcctggcggcggcgggcgcgggcatttgtccccgcgctgctgctgctttttgcgctggccgggtggatgctcccggccgcgccggggccggcggcggaggccgatgcagtgctggaggccggagagggggagccttgccccacggttccagcgggacagaagctgatcgccctcacctttgacgacggcccccgccgctccaccaccacccgcctgctggacggtctctcggagcgcggggtgaaggccacctttttcctcatcggagcccagatagagaacaacggggacgtggtgcgccggatggacgaggaggggcaccaggtgggcatccacaccttcgaccacgtcaagctcaccgatctgagccggaccgacttcgacgcccaggtggagaccacccgggccctgctcaagtccaccctgggccacaacgacttcctgctccgtcccccctacggcatgctggacgagagtgtaaaggcctgggcgggctgccccatcatcctgtggtccatcgacccggaggactggcgggatcagaacaccgaccgggtggtgcgggaggtggtggccggggccagggacggcggaatcatcctgatgcacgacatcttccccgagtcggtggacgccgccctccagattgtagaccagctccaccagcagggctacctgttctgcacggtggacgagctctttgccgcccggggccttcccctggaggccggagagatgtactggaacgcatacccataaatcggcccggggacggcgctgccgtcccagggccctgccgttcaggccagacaggccgcggccccgtaaaagccgcgggtgctccccgcctcgtccacccggaccgtcccggcctccgccatggcgcgcagccgccgggccagcagccagtcccccacgccggagagctgaaccagggcctgtcccagtacgttcgccaccttctgcggcttctccgtgaggcaacggcggaggacggggtcatagaagtcctccgatacccccatcaccctgccgttgaccaccgcccggaggggggcgttctcctccctcagccgctcccattccagggccagcatgcgcagcaccggacgggtcagctcctcagccccgcccaaatgcaggccgaactcctcgggatgtacctcgccccagccccggtcccagcgcaccaccgcgccgtccggccgctcccaccaccggggcagggaaaccagggtcaccctggcgtccagcccggccaggagggcggccgcgtggcgcaggccgcaggccccgtccggggtgtcgtccgcccagatgcgcacctcctccccggcggcggcccgggccctcagctcctccgcagcggccaggacctcccgccagtccgcgtcggcctccgccgcccgctccgcctccgccccgtccagtgggaagtcggtgtggaactgccggaacagcgcccgccggggtccgtcctccgccagaggggcggtgatgtcccccagggacagggccagccccagacagagtacgtcggagcttttgttccccagggggacggcatacctgtccagccggtcctgctcggcccgcaccttccgcatctgcgccctgactgcccggcgggagggcttctccccgtcctccgacgtgcaaaatgcaatcccgacgctgtggcggcctttgccgccgcagtgctgagccatcttcagcgctccctgtgccgactggttgaaacagagctctaccataatacgctccaccctttcaaatcaaataagacagcgccagggacagggacagcgcgccgaagcagagcacgccggggctggtgagaaagcgccgccatgttccgcgctctgcgtccggacgggccagaagcgcggggatcagccggaacggcaccatggcgcctgccagcatcagcacacccgtcaccaccaccgggccgcccagccagccccagaggatggaaaagaggttgaccagcgcgtggaggaggacggcctgccacaggcagccggtggagagcgccagctccgccagcaccagccccagaagaaaggcataaaaaaactggttcagatttccgtgaaacaggccgaagcaaagggcggaggccaccagcgcaaagcgctccccatagggccgcaggcggcgcagcagcagcctgcggaacagaagctcctccgccgcaggggcgatgagcccggccagcaggagctggagcggaagggggtagaggccgatggactccaccgggttgaccaccgccgcgccccggagccgccccagcaggccggtgaggagcagggtagccccattcgccagataggccagccccacggagccggcccaaagggccgcgaagcggaccggccccagcgggcggcgggccggggcgggcggggccgccgtcccccacagcaccagacaggcggcgggaatccccagcccgtaggcccccaggacggacgccgcccacagaaacaccggctctcccagcaggccgggccgtgccgccctggccagaagcagcaccccccactgggccgccagcatgacggccatctgggcgaacagggcccagcccaggcgggaaaagggttgacgggcctccattgcgccacctccacaaaaagattaccaaagtattatagcaattttctatctccccgacaaggaacgaaatattgacaactctctttcatgcgggtacaatatcttgtgttcgaatacaactggaggagagatacgatatgcccatttcggaaaacgcaaaggccgtgctggagcggcgctacctggcccgggacgagcagggacagcccaccgagaccgtggacggcctgttccgccgggtggccaacgctgtggccgagggtgaccgccgctttgattccaaggcggacgtggtggccacggccaaggagttttatgagctgatggtcagcctggacttcctgcccaactcccccaccctcatgaacgcgggccgccccctgggccagctctccgcctgcttcgtgctgccggtggccgactccatggaggacatcttcgacgccatcaagaacgctgcgctgatccacaagagcggcggcggcaccggcttctccttctcccgcctgcggcccaagggctccaccgtcaactccaccggcggcgtggcctccggccccatctcctttatgaaggtgttcaacgccgccaccgaggcggtgaagcagggcggcacccgccggggcgccaacatggggattctgcgggtggaccaccccgatattctggagttcatcacctgcaagaacgatacccgcgagatcaccaacttcaacctctccgtgggcatcaccgaggcgtttatggaggcggtgagccaggacaagccctacgacctggtggaccccgccaccggccgggtggtgggccagcacagcgcccgggcggtctttgatgccattgtcacctcggcctggcagaccggcgagccgggcatcatcttcctggaccggctgaaccgggacaacgtggtgcccagccagggggagatcgagtccaccaacccctgcggagagcagccgctgctgccctatgagagctgcaacctgggctccatcaacctggtcaaccacctgatgaagacccccgccgggtgggtgctggaccgggccaagctggaaaagaccatccgcaccgccgtccacttcctggacaacgtgattgaggtcaaccagtaccccctgcccgagatcgaccggatgacccgctccacccgcaagatcggcctgggcgtcatgggctttgcggacatgctcctccacatgggcgtgccctacaacagcgaggagggcgtcgccctggccgaggagatcatggacacggtgaattccatcggccaccaggccagtgaggagctggccgagatccggggccctttccccctctttgaccagagcatctacagggacggcaggcccatccgaaacgccaccgtcaccaccatcgcccccaccggcaccctgtccatcatcgccggggtatcctccggcgtagagccggtgttcgcctacgcctatatccgcaatgtgatggacggcacccaccttatcgagaccaatcagattctgaaggacaggctggtggaggcgggcatctactccgacgagctgatgcacaaaatcgtggagcagggctccctggcccacgtggacggcatcccggaggacatccggcgggtgttcgtctgcgcccacgacgtgtcccccatctggcatgtgaaaatgcaggccgccttccagcggtacacagacaacgcggtgagcaagacggtgaacttccccaactccgccaccaaggaggaggtcgccgaggtctaccggctggccttcactctgggctgcaagggcaccaccatctaccgggacggaagccgcaacgagcaggtgctcaacatcggcaaggtcaacgacggcaaggccgccaccggcgacccggtggtggacgccgtgctggactccggctgcgagggcacggcctgcctgatcaaatccggagcctacggccatatccagccgaggccgcgccccgccgtcaccagcggctttaccgagaaggtgcgcatcggctgcggcaacctttatatcactgtcaactacgacgagaacggcatctgtgaggtattcaccaacaccggccgggccggaggctgtcccagccagagtgaggccaccgcccgcctgaccagcgtggccatccgctcgggtatggaccccaaggagatcatcacccagctcaaggggatccgctgcccctcctgcctccggcagcagggcgtgcccgtcacctcctgccccgacgccatcgccaaggccctggaaaaggtgctcaaggtctcccaacagggcggcggctgccccgcccccgcgcccatcagcgccgcgtccaagactgccacgcctgtcccccaccccgatatgacccccgccgaggccaagctggccaagttctgccccgagtgcggcgcgcggctggagcatgagggcggctgcgtcacctgccgcgactgcggctactccaagtgcggctgatgccgccgtaaccccccgcctgaacctgccgcggcgggcggccacaagggccgcccctacctccggtgatcaaactggacatgctgcccagaaaaagcgccccgcgcacggcttttcactgtgcgcggggcgcttttttccgtgaccccatacagaccggtgcggcgggggtgttacgaagtaagcccccgccgccggaaagccgccagcagagtagcccgggggaagttccaagaagggggaatcgcaattcccccttcttggccgtttcaaggggtggattgttaaggcgggggaaatcggcatcccccgccttaactggctctttcgcccctttctggccactcagaaaggggcccgccggaggcttgacaagaaatcagatacaaaaaggggttgcatggaaggtgcatcagcctggcatatgtcgggccgatgtgggcagaaggtgaattgccccgaaggggcaagagaggccgccctggggcgtcggcccctacgctagggggacgcccgtcccaacgcataacggcgtaggggcgacccttgtggtcgcccgcgggcggccataaaggccgcccctacaacatattttcggtcccctgaaacgcgcaggatgtaggggcggggcttgtccccgcccgcaggccgggcggctgtagggctcagcggtttatctcccttttgtccgtgcgccctaaaatataatccactgagacattataataatctgccaaagcgagtaaatgccttgttgggggcaaggcatctgtaatttccaaacgctgatagtttctcccctgcactccaatcatttcagccacttggttttgggtcaggccggcttctttccttaattcctttaaccgttcttttgtcataatacccctctttcctattgacacgatgacaatcatcgcatataataacgatgatcaccatcgtgttaaggaggttttttcatggacgatatcttcgaggagctctactatcagtttgtctatctcccgaaaaaggacgcctgtcctgagcgcaccgcccgttgggaacccttcttccacggcgctcccctggacctggtcgacgccaaggacggactggtctacaacgcctccctcacgggctttcaggaagggtttcgtctggggctccgtctgggactggccctccctcctcctgaagatctgcaactgtgagggccatcagctcctccttgccgggcttctccagggcggccacccggtcggactggcgggccaccgcccgctcaaatacgttgcgcacgtcccgggcgtttccgaagttctcatcccgctcctcatagagtgttttaaaatacgattcggcatattccgtcgctttatcatccaacgtatacccatttttcgcacacatggactgaaaaatcgccagaagctgggccccgttgtagtcctcgaagtaaaaatacttgttgaagcggctctccaggccggggttggcgtggagaaagcggcccatcagctcggtgtagcccgccgcaatgacgatcagatcgtcccggtggtcctccatccccttgagcagggtctcgatggcctcccgcccgaagtcgttgggggcgtcctggttggccagggcataggcctcgtcgatgaacagcacgccgcccagggccttctcgatgacctcgccggtcttgagcgcggtctggcccacgaagccggccaccagcccggagcggtccacttccacaagctgccccttggacagtacgccgatggcccggtagattttggccagcaggcgggccacagtcgtctttccggtgcccggattgcccagaaagaccaggtggagactcatgggaggtacgggcaggccgtgctcctggcgcagcctgcgcaccttcaccagattgatgaggctctttacgtcggccttcaccttgtccagaccgcacaggccgtccagctcggccatcagctcctccaggctgggggcgggctccgcctcctccccggccgccgcagccgcctgtcccgctcccgccggagcggcggccgcggcgggggcgtccgccttgggaggcgcaggccgccgggtaacgaagtccttcacgtccaggggcgccttctcccccttgaggccgtcccggtcgcagagggcggagagggtgtcggcacaggtgttgacgaagcctgcctcctcctcactcaccacgtcgtccacagcggcaaagagcaggagcatcagggtgaccaggtcgataaaacggcgggccaggtgggtgccggacaccttgtcgcaggcccgcatccgggcgaagaagtcgggcacccggaagccggggtactcgctgacggcggtggacagctcccagaacagaatggagggggccggattgcccttggtatagatggcattatagtactccacgtggcggggggtgagggaggcgccgtcccgctgccacacgcccagggcgcaggcccggagaaagacatccgcctcctgggtgaacttcacccgcagggtggcgtctgcgatctgccgccggaaggcggtcaccccttcactgtactgcttgtgcacctcggcggcgctgagagaacctttcacgctgcaacacctcgtttttcggttactgttattatatccgaatcagaccgcccgcgcaaggaggcagttcagttgacataaatattaaaaaacctttacatttttccccacgccgttgacggatggccgtccgccgttgtaaaataactctaagaatgtcgactggagggatttccgatggcatccaagcggacccgcgccaataagcccgaaatgatccactgcccttactgtggggaggactactcctctacctataagcactgccccttttgtgacgaggtcgagcccgcggaggacgactaccaaaccgacgaatacgacgaggccccccgctccaggggcggcaagcgcctggtgaccaatacccggggcggcggctacggcgggggcacttcaccgctgaagatcatcggcacggtggtctccctggccctgatcgtggcggcggtcatcatcgtcatcaccatcatccggcccctggtagccaagggcgacgtggacggcccggcggacaacaccacgccggtggaaagcgtgacccccaccccggacgccagcccgtcggagaccgagcccgccggtgagagcacgcctccagtggcggagacccccggcgacaccatccccgaggggcagacggccaccggcttcactctgagcaagagtgagtttaccctcagcgacaagtggcccaatcccatcaccctgacggtcacctttatccccgacggctccgccgggaagatcacctggagcagcagcgaccctgaggtggtatcggtggacgagaacggcaaggtgagccacggcagcaagcagggcagcgccaccatcaccgccaccatggccggcggcgtcacccagacctgtctggttcacaactccgtcacctccggcgcatcctcctccagcgggagcggctccggcgcctccggcgccctgtccctcaaccggacggacttcaccctggaggccggacaggccttccaggtgaaggtgagcggcacctcctccacccctacctggagcatcggcaacaccgccgtggccaccgtctccggcgatggcaccgtcaagcacgtgggcaagggccaaaccaccctcacctgcaccgtggacggcaagaccctaacctgcatcgtgcgctgcaactgaacctgaatagcggcatggcaccagggccatgccgctcagcctgtcgaaacagtcgtttcgacaggctgctggactttttgaaccctttaaacggttcaaaaagtcgtttgatccaacgcgaaagggaaccctgacggttcatctccgcgccaaacgccgccgcagagcggcggttgcgctccgaatcgccctgcggggcagcctttcacactatccctccctccgaaacctctggctgaagggtttatcagcagtcttgagcggcatggcaccagggccatgccgcttttttatatctcctatctccggccccggcgggccgcatccagtccaaaaaggggatatgaccttcgcggtcatatcccctttttgactcacacctccatgatgacaggcaggatcatggggttgcgcttggttttcttgtagaggaaaccggagatggcgttcttgatctccgacttgatggaggcccaatcgttcatggtgtccatccggcactcctccagggccttgacggccaccttccgcagctcctccataaggccctcggactccttgacatacacgaagccgcgggtgatgatgtcggggccggagaccacgctgccgtcctccccggacatggagaccaccacgacgatcatgccgtcctcggccagatgcttgcggtcgcggagcaccacgctccccacgtcgcccacgccgtagccgtccacaaacacccgcccggcgggcacggtgccgttgatcttggcggagttgggggtcagctcgatgaccttgccgatgtcgctgatgaggatgttcttggggggcatgcccatctgctgggccagcttggcgtgggtcttgaggtgccgctgctcgccgtggacgggaatgaagaatttgggcttcaccagggcgtggatgatcttcagctcctcctggcaggcgtggcccgacacgtggagggcgcccagccgctcgttgaccacctcggcgtccttgcggtagagctcgttgatgacgctgccgatggcgttctcgttgccagggatggcggaggcggagaggatcacccggtcgccggcctggatctccacctggcggtgggtgttgaaggccatgcgggtcagggcggacatggtctcgccctggctgccggtggtgatgatgcagatcttgtgcttgggcaggctcttgatgtgggccagatccaccagcacgccgtcgggaatgttcatatatcccagctcggtggacaccttcatggcgttctccatggagcggccggtgaccgccaccttgcggccgtaccgggccgccacgtcgatgatctgctggatgcggtccacattggaggcgaaggtggtgacgatgatgcgctgctggcagccgcggaacagggcgtcaaaggagtcgcccacgctgcgctcgctcttggtaaagccggggcgctccacgttggtggagtcggccagcagggccagcacgccctccttgcccagttgccccaggcggcccagatccatcatgccgccctggatgggggtggggtcgatcttgaagtcgccggtgtgcaccaccgtgcccacaccgcacttgatggcgaagcacaccgcgtcggcgatggagtggttggcgtggatgaactccacggagaacttgcccgccttgaccacctcgcccgcctcgcaggtgatgagcttggtcttgttcagcaggcggtgctcctccagcttcagcttcaccagccccgcggtcatgcgggtggcgtagatgggcacattgatatcccgcagcagatagggaatggagccgatgtggtcctcgtgtccgtgggtgaggaagatgccccggatgcggtccttgttcttgatgagataggagaagtcggggatcaccacgtcgatgccgtacatgtcgtcgtcgggaaagcccatgcccacgtcgatcacgatgatgtccccgccgtactcgtagacggtcatgttcttgccgatctcattgagtccgcccagggagatgattttcagtttttcagccatagtaagtcttggaacactccttttattctgaatccatacaaatggtatgtaaggaccagcggagcaggggcgcacgaaaccaaggcggtcccggtcccccgcccgttccggccctgcctcgccggaaagagggggcggccgctccgccgcctggcgctcttctatgcccgctgtgtcctgcttattcaagcgcaaaatgcgcataaagccatgataggttattttagtataccatacctttgcggaaaagtatacctctatttttccggcaggccccggtcggcctcctccgcccggcgggcacagaaggcgcacagctcctcggccagctcggcgctgcgggcctctcccacgatccgcagaacggcgctgcgggccaggggcaccagagtgacccacccctcgccctggcggacccgcaggccgcccccagccggctgtgccccgggcagggtgcgcagcagcacagagagcacctccccctgcccgcttcgaagggaaacctcccggcggcggaggacgaagcggggaatcttccccgccaggccatggagccgctcaccggtcatgcccaggtgggcgcagatgcggcaggcggcaaagagggcgtcccgcagccagggcagctctccgtaccgcgcctccgcctccggcccgtcccgacccagccggagggcgccgccgtggtagccggcggccagggtgtcgatagctgctggggcggcgtcgggcaccgctacccgccccgccccatcctcatattcgatgagggccacaatggtgagcagctgctccggcgggaggggttctccctcctcatcctcggccagcagccggaagccgccccgcccagtgcggaaggcgggcacgccggggcatgcctccctccggacggtgcagcccaggcgctccagggcttccgccagggctccgtccgccggttccctgccgggcaccgccacctccaggcgccggagcggagcctgggtcacctgggaccgcttggccgcatcggcggcataggccgggcggacgccggtgacggactcccactggcccacccgcccggcgggcatccgccgcagctcactgcgcagcagggccccctccagccggcgctcccgcgcccggcccaggggcatgccccggcggtcaaagaagtagagccgggcccgctccccttcctgctggacaaaaagggacaccggcaggccccagctctccgccagccacgcggcggcggagggacagggcgcgtcgtgggatagcacccggcctcctgcggcggccgcgccgctcccggcggcctgggccagcatccgcgcccccgcgccgcccgcccagcccaggcccacggtgccctcccggcccagcaggccgcccaggacgagcagggtctcggcggtcagctcggccccgatggccccctccagggtgccgccgcccccgaaggccaggggcggcttcaggccgcccgcggtgagggaggcggtgagcctcgccccggcgggtacccggcggccgggccacaccgccacccgctccaacaggatcgcgtcctccccggcctcggcccggtcggccaggagagccccttcattgagcaccgcccctgcccgggccgccgcgccagggcagagcaccgcgccgtacagggtggtgcgctcctccgccgccgcgcccagcagggcggagcgctggaccagagcccggcggcccaccgtggagcccccctccagcaccgtgtggggccccagcagagagccctcccccacctggacgccgggaccgatatagcaggggggcaccacctgcaccgagggcggcagggggctggcgctccacacaccgggggcggtgcggggggcgtcccaccgtagccgcagcttgcccgacaaagcgtcggccagcgcgtccagataggcttcgccgccggtgagctcccgccactgcccctccgggactaccccgtacagggcctccccccggtccagcagggcggagaggcgcccggccagcgtcccctccccggccgccccggcccgggccgccgccgtgaggatgcacacgccggtttccacctgactggccagcagacggcctgccggggcgtccagcagccgctccacccgcccctccccgtcggagaacaccagcgcccggcctgccgccggagggcggtgggccagcgccagggtggcggcggagcggtgcacctgatggaaggccagcagggcgctgagatccaggtcgcctagtccgccgccggggagcaccagggcgtcctcctcccccagaaacccggcgcaggccgccagcagctccagctcccccgccccccggcagggcagccacgtgaagcgcacccccagctcctccccgtcccccatcgcatcctccaccatgcgggacaggcgtgggagggccacaccgatctcccgcacgccgtggcggcggagcagcccggcctggtgggccagcaggggcttgtcgaacagggacagcaggggcagggggcgctccagcgtcaggggggcgagcctctcctccccttccccgcacagaatgatcgctttcaaggtgggaaaccatcctttcacacacagtttcccgtattattgccggaaccgcccccgtatgatacaatattgtgagcagagagcaaaggagaacggccatgaacattcagatttttggaaaaagcaagtgttttgacaccaaaaaggcggagcgctggttcaaggaacggcgtatccggttccagtccatcgacctggggaagtacggcatcagcccaggggagctgaaaagcgtgctgaacgccgtggggctggaggccctcgtcgaccccaagcaccccgacgccgccctgctggcctatctggcctacgacgccgacaaggtggaaaagctgctggacaaccccaggctgctgaaaacccccattgtccgcaacggcaggcaggccaccgtgggctactgccccgaggtgtggcagggctgggcataagcaaacgtgccggggcgcaggccgccccggcacgtcagcctgccgaaatgtcatttcggcaggctgttggactttttgaacctataaaaaggttcaaaaagtcgattgatcccacgcgaacggcccaggccggcctctcttggcctgcggccaattcacctccagggaaccctgacggttccctttcacactatctctccctccgaagacttcggcaggagatactgtcgaaagcctcaaatgtgccggggcgcagaccgtcccggcacgtccccttattggtagagggccgccaccccggccagctggcgcttcagctcctccgccgcccagtcggggcggagaatctgcaccccgtcccccaggccgaacacccagcccaaaaactgggggctcaccaccgccggaacggtgacggtgaagtgctcctccccgtcgggcaccagaatggcgtcccggccaaagcggtccagcaccacccccaccagactgttgcggcagcgcagggtaatctgcccctcccggccggagaacataccgaagtgcttctgcgcataggatgcgatatcaaaacccccgtccgccccctccaggggcaggcaggtcaccgccagctcggccatcttgtccacccggtagtggcgcatctcgcaggagcggtggtcatagcccgccagatagtagttctcgttgtcccagatgagccccaggggggagacggtgtaccgttttccctcccggcggaagaccttttcctttttgacgttatactcaaagtatttaaaggtgaccgctttccggtttgcaatcgcagtgtggagcttgtcgatggtgtagtacacgctctcattcatgctcttcacccggcggtccacatacacctgccgctggagctggcgggcctggtgcaccgacgcctgggactccagcttgcggatgagctcgctgctcttgcgctgggtgatgaacttggaggactgcaccgcgtccaccagcagcttcagctcggccagttgaaacgtccgctcccccaggaaccagcccggggactttcccttgcggctctgcacgtccatacccagggtgcgcagtgcctccatatcgtcgtaaatgctcttgcgctcggccttgatgtcccacgcctccagggcctgaatcagctcgggcaccgtcatcgggtggtcctcgtcggtgcgctcccacagaatcctgcacaggcagagcagcttgagcttttgatttgcacttcgcggcatgcctctctcccccttcctttctctcagaataacggttttttagtccaataaaccgtacttttttagcatagcacaaaattgcacggattgcgaggttttttcatggaagttgtagtctctgcccccctgtgccccctctatgccgccgccagcgccggcgcggagcgctccgacgagctgctgtgcggctggaccgccgagcttctggaggaattctccaccggctggtgccgcgtccgcaccaaataccgctacgagggctgggcccgccgggagcatctgcgccccgccggggactggaccgggcgaaacaagcggctcgtccgcgccccgtttgccgacgtgctggcccggccggaggtggagagccccgtgctggacaccctgccccggggggcgctggccgcccccgtcggggaggccggggagggctggcagaaaatagccctcccggacggccgggagggctatacaaagtgtagtctctgggaggatgattacaaaacgccccccgccgtgtccgaggaggccctgcgggcccgggcggtggaggtggccctgtcctaccagggcacccagtaccgctggggcggtaagtcccctctgggcgtggactgctcggggctgaccttcatggcctggttcttctgcggggtgtccctctaccgggacgcccggctggtggacggctttcccgcgcggcccatcccctttgaagcgcggaagccgggggatctgctctatttccccggccatatcgccctctatctggggaacgaccggtacatccactccaccgcccgggcgggcagcgacggggtggtgatcaacagcctggaccccgccgccccggactaccgggcggatctgcgggaaaagctgtacgccgtgggcagtgtgttcccgctggcgtaggggcgggcgggtatgggcacccgcccctaccgctggtgcgtctctccgtgggggcggcccttggggccgcctcctctttcgtgatctccggtggtgggacgtgagacggcgggcggggacaagcccctcccctaccgccggtgcacctttccgtgggggcggcccttggggccgcccccctcttctgtgatctcaggcggcggggcgtgaaacggcgggcggggacaagccccgcccctaccgttggtgcgcctttctgtaggggcggcccttgtggccgcccggccgtcaccactccggctcgggcaggcgggtcagggaggtaatatatcccccacgcacggtggcttgcagggtgaggcggtttacaaagggatatggttccggatgacgacgccagtacagctcgtccgaatcggcgcagaattcatttaggaaggagagaacgcccccctcatagggggttccatcctcccggcagagatccgcctcatccacgcggaaggtggaagtcccgatcaaatttgtcacccgccaggtatcctcctccacttcatacatccgcgccttgaagcagattggaaatccactggcgttctccgccctgaaatcgtacaggtttccgatgatatagtccccgtccggggcaagctcctccacgctgaaccgcgcctcccaggcggtcagggcggtgattttgcctcccgtcacctccagctccagcaccgcccctgtgccccaatccggccggttcaagaaatcgctcagctctgtttccccgccgcccagaaccacatcctccgccacagggagggaaataccggagaatccatccgtggtggtgacggtcatcgtatcgggatccatcgtcacactcctcagagagagttccctgccgcgcttcccggcctcctcccagtctgtggcgctcataggaatggcccagtaggtgccgtcgggcagccctgtatagtgggaggcggggtgatccgccttttgctcccactggctcaggggatccggatccagtggcaggttggcgtcatgccaggtcagcgccgtgatctcgccgccggccacctccgcctccagtaccatgggccagtaggaggagattgccgcccactgcaaaaagccatccaggccgctgtcgccgtggttgcccagtgtcacgtcgtccgccacagggaggctcgtcttctcaggcgccacgcgcagaagcgtcatggtgtctgtgtccacctccaccagggagaggagcagctctatcccctcctcccccgccgtccaccagtccgacagggacagggtggcccagtaggtgccgtcaggcaagctctcctccggcgcgcgggactggcaggccaccagggggccgcccagcagggcggcgcacagcaccaggagcagggcggcccggccgggccgcttggcggaggcgtccatcagggcgcggaaccgctctttcagtccccgggcgcctccggcgaactggctggtcaggggggcgggccgccccgcgggcacaaaggagagcagggccgcgccgtaccgccgccgccactccccgtcccggccggccagcacggcggcgtcgcaggcgatctccatatcccgctccgccgcccggcggagtagccagaccaggggattgaaccagtggagggcacacacccacagcagcagggccttgctccacagatcccggcggcgggcgtgcatggcctcatgggccagggcaaaggcccgccgctcctcctccaccccctcgggcaggaggatgcggggccgcagcaggcccgtcagcgccggggaggacagcagagcgcaggcgtataccggcaccccctcatacgtccccgccggggtgcaccaccgggccgttctccggcggaaggcggcgtaccggagcagccgccccgccagcactccggccgccacggcggcccaggcggcgaaggccagctccgccgtggtgagggacaccccccgcccggcggcctccggggcggcctctcccggcgggagcgtccgggcggtcagctccaccccctggaatcccccctcctccacccaggcagccgacaccgccgccggggcgggggcctccagaaccaccggggcccggggcaggctcacgttgaagggcaccgccagccgcagggccaccaacagccacgcccagcaccgccactggggccggaagcggcgcttccacaccggggacagaaccagcagcagggcggtcaccgcccccatagtgaggctcacctcaaacaggccggacaggaactcacgcaccgccgtccccccctctcagaatctcctccagctcctccagatcccgccgggagatggcccggctgtccatgagggcggccaccaggctgggcagggagccgccgtggagccgctggagaaaggcccggctctcggcggacaggtagtcctcccgccggacgaggggggtatacaggttattccgcccctccttctcccgcttcacaaagccccgctcctccaggcgggagaggagcttgagcagggtggccgtctgccaccgcctccccgccagctcctccatcagcgcggcggaggagacggggtacttctcctgccgccacagggcctgcatgacctccagttccgcatccggcagccgttccattccgttcaccctttcataagacaattgccttttcgcttttattttacaattgtctcatcactttgtcaagaaaaaagagcgcgccgccggcgcgctcttttgttatttccgctccttgtcccggacaaagaagtgcttcatgttggactggccgccctggcggacgtccacctcgaaccggggcagggccttgaccagcttgctcagcttggagaagccaaagttgcgggggtcgaagtcccgcttcttgcgcaccagcaggttggccacctcgcccaggggggcgtagccgtcctcgtcggccagcatctccaccgagtcggccagcagggtgatgatctccttgggcaccctggaggggggctcggcctccggcgcggggggcggggcggcctcagcccccttctttctggccgcgcgccgggccggtttgggcggctccttcggctcctcccgggcggcctcctccgcccgctcctgctgggccgcggagcggatgacctcaatatacacaaacttgtcgcaggccacaatgaaggggtttggggtcttcttctcccccatgccgtacaccttcttgcccgcctcccgcaggcggatggccaggcgggtgaagtcgctgtcgctggacaccagtacgaagccgtccacctggccggtgtagaggatgtccatggcgtcgatgatcatggccgagtcggtggaatttttccccgtggtgtagccgtactgctgcacgggggtgatggcgttctccagcagcagaggcttccacgaggccaggttgggggtggtccagtccccgtaaatgcgcttgatggtgggggtgccgtacaccgccacctcggccatcacgtcccccagggcggagcggggcgcgttgtccgcgtcgatgagcaccgccaggcggagatccctctcttccgacatatctccccctccttacagcacgaaatggcagaaccggagcacctcgtaccagtcctccgcgtcaaaggagatggtcttgctgtcctccagccgggcgccggggtaaaagctgcggcggtaggcgtccttgtgctccttgtagcgcacggtggcggcgaaccgccggggcaggggtacggacatgcccgcccctccggcgcgcaggcggcgcaccgcctcctccgccccggcccggatggcctccacggcggcctgggggtgcatggacagcaccccgccgccccggccctcgttcaccggcacggccaccaggccgggcagccagtcctgggcaaacgcgcacagctcccggtcgccggacaggaaggccaccggcacgccgaagtacagggcggtataggcgttgatgaggaattcgctggccgggacgccgttgagcgtcacctggtcgcaggcggtggtcatggtgtgggacagggggttgccgccgcagcagccccaggcgtggtagcccgtgaagagcaccccgccgaaggccccccgctccagccccgccatcatgcacaggggatcgcccgtccacccccggagcacccgggcctgccggggcagccgggccgcgtccaggttgcgggcggagtcgtgggcgtccttcaccagaatgtcctccgccccggcggcgacggccccctcgcaggcggcggccacctcggcggtcatctgggcggcaaagggcctgtagtcgtccatggtggcccgctcggtctccgcccagtcggcaatgccgcaggtgccctcgatgtcggcgctcaaatagagtctcatttcaacccctcccggcggcgcacaagctcctccacctgggccagctgctccacggtgttgacccccagcatctcctcggcggtgcaggtggggcaggcccccaccctgccgcccctggacaggatgtaggccggggcgtcggtgaggtagtactccccctgggcgttgttgggcctgagctggtcgatggcctcccacagggggccgctctcaaagacgtagacccccacgttcagctcccggatggccttctcctcgggggtacagtccttgtcctccacgatgtgggagaaggagccgtcgcttttccgcacgatgcggccgtagggcagctcctcgtcggacacggcagagagcagcgtgcagtcgttgccctcccgcttgtgggtctcaatgagggactcgtaggtggcccggcgcatgaggggcatgtcgccgtagcacaccagcacgctgccgtcaaagcccgccagggcctcccgggcgcactgcaccgcgtggccggtgccctgctggggctcctgcacggcgtgggggtactccgggtaggccgccagcaccttttcccgctcgtaacccaccaccagcactacgtcctccttcttcaaaaaggacagctcctccagcacatagcccagcagggggcggcccgccgcctgccgcagcaccttgggcagatccaccccctcggtgcgcaggcgggtgcccttgcccgccgccagaaccaccgccttgattccattcttcacggtattcaacctcgtttctctcaagcatttctcagcttcatttgatcgctagtataacacatggaccctctgttttgcaattatcccaccgtatttcatacaattttgcccttgacttttcccatcggggaagtataataaaagtgctttagcagaggcgcgccgtttcccacgcgcgcctctttgggggaattggagcagtagcgcatcagggggcccgggccccctgtgcatgccggccggcatgctgccgcagctcccgccggttccgtgcagaactgagaggcggcacggagccaaacagtctgaggaggaatcactgatggttacattttttgtctgcctggtgctcctcatcgtcggcttcttcacctacagcaagctcgtcgagaagatcttccgcatcgacgaccgccccacccctgctgtggctcaccccgacggtgtggactatgtacccatgaaaacctggcgcatcttcctggtacagcttctgaacatcgccggcctgggccccatctacggcgccctgtccggcgcctgctggggcccggtggtgtatttgtggatcgtcttcggcaccatcctgggcggcggcgtccacgacttcctgtccggcatgatgagcgagcgcaacgacggcaagtccatctccgaggttgtgggcctctacatgggcaaggtcatcacctttatcatgcgggtgttctccgtggtactgctggtgatggtgggcgtcaacttctccgtgggccccgccggcctgctggccaagctgacccccgacatgctgggcaccatgttctggctggtggtcatcatggtctactacctgatcgccaccttcctgcccatcgataaaatcatcggcaagctctaccccgtgttcggcatctgcctcatcatcatggccctgggcatcggcggggccatcgtgctcacccgcggctccgacatgccggagctgaccgccgcggccttcaccgtggtgcaccccgacagcctgcccaagtggtccatgatgttcgttaccgtggcctgcggcgccatctccggcttccacgccacccagtcccccatgatggcccgctgcatcaccagcgagaagcagggccgcaccatcttctacggtgccatggtggccgagggcgtcatcgccctgatctgggccgccgcaggcgtcaccttctacaccaaccacggctccctgctggacggcatgaccggcctgaccaacgccatcgccgccggcggcgcgggcgacgtggtgtaccagatctccaccaccctgctcggccccgtgggcggcgtgctggccatgatcggcgtcatcgcctgccccatcacctccggcgacaccgcctaccgctccgcccgcctgactatcgccgactggttccacatcgaccaggccaaggtgggcccccgcgccgccctgtcagtgcccctgctggccgtgggcgcggtaatcgccctggccctcccctgggacgtgctgtggcgctacttctcctgggccaaccagaccctggccatgatcgtgctgtggaccggcgccgtgttcctgcacaagttcggctatccgcccaaggcgtgcttcatcgcggccctgcctgccaccttcatgtccggggtgtccgtgacctacttcttccaggcccccgagtgcctgggcttgtccaccgccatcgcctatccggtgggcatcgtggccgccgccctgttcctgggcatcttcatctggcggaccctcatcgtcggcaaggacgacgtggccccgctgcacgcggccaagaactgaattttacccgccggacgcgggacggaagtatccgtcccgcgtcttttttgctccgcctttgccgggcaaagaaggtcctgtgcgcatgaagttttacaccccctgcaacaatttgccgttccaaagcgtatatagggtgaaagggggaaccgagatggacggccccaaccggttggaggaacttgtcaacacctacgaaaccacgctgtaccgcgcggccctggccattctgggcgacgcccacgaggcggaggacgcggtgcaggacgcctttctgcgctgtctggaaaaggccccggactttgagagcccggcccacgcccgggcctggctgctgcgggtgacggtaaacggctgcaagagccgcctgcgcgccccctggcggaggcgcaccgcccctctgctggacgcctatcccgccgccgcgccggaggaggggacgctgctggaggctatgcaggccctgcccgcccgggaccgggcggtgctccacctctattactatgagggctaccagaccgcggagatcgccgccctcaccggcctgcgggagggctcggtgcgctcccgcctcacccgcgcccggaccagactgcgccaagtgctgaaaggagaagacgaatgaagcactatcgctcttatatggaccgtatcaccgcgcccgccggactccggcaaagggtgctggaggcggcggagcaaggggcgcgcccccgcaggcccgcccggcggctgaccctccggctggcggcgctgtccgcctgctgtgtgctggctgtggcgggcgggcggctgctctggctgggcggctccgcccccatccccaaccccaccgccggcatggccgccacccccgccccggctgcatcttctcccgcttgggagcacaccctcactgtgggccccgggccctttgccgaaggggaggcccacaacttcttcgacatacccgccctaaatttccccgactgcactgatttctctccccggttgacggaccgggattggggggtgagttcctttgaggagaagctgaccgcccaggagatcatcaccgctctggggggcacgggggaggttccctggtccctgctgtgggagggctatggactggacggccaagttttttacaacgagaagggagatgtattgcaggtggtgatcaccggtgtgcgcggggacgaccgcctgcggctcgccctctcccccggccggctccccccccgcagtgtggtgtatcaggaggccgctacccaggcggtcaacggcattcccgtcaccacggcctccttccgcggccagtctgacggccggacgctgactacctgcgccgccgacttcctggcgggcggcaccggcgtctcctttgaatacctctcccccgatgccggacagtccacctggctgaccgaggtgctggcgtggtacggcaccggtgccgacagcggcttcaccacagagcatctgaacgccagaattcatcccataacagggcacgagcctccggcggaaggggaggccggcggcggggtggtggttcccgttcccatcccctcccccacaccttggcaggtctatcccctggagtaaattcaaaatgtttgtcgctttttccaatcttttttgatttcacaggacgagatgcggtgatcttttcccttgacgccgggcggcgggcacgcctataataaaccgcaagaaccagttgttgcggtttacccccgctgcaatgatagaggcgcggaatcgcaagagtatccggcataccctgcaatggggcagagcaccccgccggagaaagggcccttccgccgaagggccggtcccctgcctggaggaccggttgcctgggccgttgggataacatctcacggactgccacatatcatctgtgtggagcgctatcattgaggccaagggctttcgttgctgtgcttccctctgcccgcatgccctggagccggtacagccgctccccggtaccgccgcgcccgagggaggccggttttcgacgctctttgtcgccatgaacgcttccaccaggaaggttcatggcgctttttttgttaaaaaagcgccgaaaaactagactggaggaaacaaacatgaatcgaaacaccctcgccgccctgtccctcaccgcctctctctccctcactctggccgcctgcggctccggcggcggaaccgctcagagccccgccccggccgcatccacgccccccgccgcatccggcgcaccgtccggcggcgtggaggacggcgtgctcacggtgggcatggagtgcgcctatgccccctacaactggacccagatggacgactccaacggcgcggtgcccgtctccaacgtgccgggggcctatgccaacggctatgatgtgatgatcgcccagcgcatctgtgacgccaacggctgggagctggaggtggtttccaccgcctgggattccctcatccccgccctccagagcggcaccatcgacgtggccatcgcgggccaatccatgaccgccgaccgtatggcccaggtggacatggcgggcccctactactacgccgacatcgtctgcctcaccaccgccggcagcgcctacgccgccgcccaaggcatcgccgacctggcgggcggccgctgcaccgcccagtcgggcaccatctggtacgacacctgtctgccccagatccccgatgcccagatccagaccgccgcggagaccgcccccgccatggtcatgcagctccagaccggcgcggtggacttcgtctgcaccgacctgcccaccgccaccgccgccgcggcaaacgactctgacctcatcgtgctcaacttcgccggcaccgacggcgacttccagtttgcctccgaggcggagcgggccgaaaacgtgaacatcggcatgtccgtggccaagggcagcaccgaactgctggacgccataaacgccgtactggacgggatgaccgccgacgacttcaacaccctgatggaccaggccatagccgtccagcccgaggtgtaagccatggaacgcgttctcgcactcggacaggacatggcgctcctgtggaccaggtacgcccccctctacctgagcggcgtggtgaacaccctgcttctggccgtggcggccaccgtcctcggctgcctgatcggcctggcctgcggcctgctcaacaccatccccatccacccacaggaccgcctgccccggcgagtcctgctgcggctgctccgggccgtaatccgtatctatgtggaggtctttcggggcacccccatggtgctccaggccgtgttcctctactacggcctgccctacttcaccaacaacgccatgcgctttgacaacgtatgggccgccgcccttctggtggtctccatcaataccggcgcctacatggccgagtcggttcgcggcggcatcctctccgttgaccccggccagaccgagggggccaaggctatcggcatgagccacgtgcagactatggtgaatgtcatcctcccccaggccctgcgcaatatcatgccccagatcggcaacaacttcatcatcaacgtcaaggacacctcggtgatgttcatcatcggcttcactgagttcttcgccgcccaccgctacatcaccggcgtcaaccccatgtacttcccctccgcggccatcgagatgctgggctacctttgcatgacgctggcggcctccgccctgctgcggctggcggagcggcggatggacggggagagcagctacgagctggtccaggccgacgccctgaccatgaccgccggcacctaccgccgccggacccgcccccaggacgaagggggggcgctgacatgaccctggaacccattctggaggtgtgccacctctccaagtcctttgggacgcaccaggtcctccgggatgtgaacttcactgtccaccccggcgatgtcaccagcattctgggctcctccggctccggcaagtccaccctgctgcggtgcatcaacctgctggagcgccccaaccagggggaggtccgcttccacggccggtccatcaccggccgtgggacggacgcctccgcttaccggacccgggtggggatggtctttcagtctttcaacctcttttccaatatgaacgtgctggagaactgcatggcgggaccggtaaaggtgctccgccggagccgtgaggaggcgcgggccagggccctgcgctacctggagcaggtgggcatggcgccctacatcaatgccaggcccaggcagctctccggcggccagaagcagcgggtggccattgcccgtgccctggccatggagccggaggtgctcctcttcgacgagcccacctccgccctggatcccgagatggtgggagaggtgctggccgtcatgcgggcgcttgccgccagcggcatgaccatgctggtggtcacccacgagatggcctttgcccgcgacgtgagcagccaggtggttttcatggctgacggccggatctgtgagtcaggcgcccccgacgccttcttctcgtcccccagccagcccagaacccaggaatttctggcccggtttatggcccagtaaccgccccgcacagggcctcccggcgctggcggcgctccaggtagaggaacatcgccagacacaggacaatctgcaccgtgctggaggcgggggtgcccagcccaatctggaacagggtggccccggggatgcggctgaccagataggcgatcgggatgcgcacgccgaaggcgccgatgatcccctgaatcatgacaaagagggtcttctcacagccgttgtagtagcccatgaagcagaacaggaagggggttagcatgcagtcgatggcgtaggccttgagatagctgtgggacgcggcagccaccgccgcgtccttggcaaacagcagggacagggtgtcgccgtggaaaaaggccagccaggccatcaccagtccggcggcgaaagcggtcaggataccgtagcccagcgcccgcttggcccggcggggctggccggcccccatgttctgggctacaaaggcggacatggagtgcatataggccgaggacaccagcatgaggaagacgcacaccttctccgccacgcccacgccggcggaggcggtgacgccgaaggtattcacgatggtctggatcaccaggaaagaggtgcccaccagcagctcctgtagggccaccggcaggcccagcctcagctccagcgcgatgatgcgcccgtcaaagcggacgctccgccgtgagaagtggaagggcagccgatccttccggcgctggatgaccgccagggagaccaccacgctgaccgcctgggcggccaccgtggccagggcggcgccggccgcgcccaagtgaaagccctccaccagcagcaggtcgcccccgatgttgatcacacaggccagcatcaccgtgaacagcggcgtccgggcgtcaccgatgccccggaacaccgcccccagcacgttgtaggccacgatgaacaggctgccgccgccgcagatgcggatgtactccaccgtttcggcaaaggcctcctccggcgcgtgcagaaggcgggcaagaggctcggctccggccagcaggaccaccgtcagcagcaccccgaacgccgcgaacaggcagataccgccgccgatggcccttccggcctcgtccggctcaccccgcccgatgcgctcgcccaccagaatggtgatgcccatggacaggccggtgatcaccatggtcacagtggacatgagcatgcttccggtggcgacgccggagacatcggcggtggcagcgaactgccccaccaccagcaggtctactccgccgtacagtgcctgaagaaacagcgtgaaaaagaccggaacggcaaagcggatgagggtgtgcaggatgttcccctccgtcagtcggttcgttcgtttcatgtgattctatcctccgttttctcccaatgagcttcgctcctccggcatagggcttcatgcacacagaacacaccacaaaacgatgcaagggcctgggtgcatgaagtttttgcgcatgtgggccgtcccagcccacacgctttcatcccatggccgtgacgctgtaagcgggcacatggccaagtctgctatgtgtttgcacagcaaaaaagccggacaaggtgcggacttctcagtccgtgccttatccggctcctcatttccactgaatgagttgccctccgagcgagcatccctattatagcaaatcatcccccattgtcaaggggatgttaaaaacggcggccccgcgctgcggggccgccgttttactcggtcaggtatcgtcctcgatcaggccgtagccgccgtcgttgcgcttgtagaccacggcaaatgctccgccgtcatccgcgttcttgaaggcaaagaaggtgtggtccaccaggttcatctggagcaccgcctcctccaccgtcatgtgtttgatggggaaacgcttggtgcggacaatccggaattcctcctcttcctcctcaggggcaaaggaggaaacctcttcggcatccacggttcggacgaatgcatcctggcgcagccgcttctccaagcgggccttattcttgcgaagctggcgctctaccgaggagaccgccgcgtcgatggtagcaaacatatcggaggtactctcagacacgcggatgatcgtgctgccggagcgcacggtgagctccacgttgttccggtccttctccacgctgaagacgatggcggcctccgcgtccgccttaaaataacggtctaatttacccacctttttctccgcataggcgtggaccttgttgggcaggttgacctttttgtctgtgaacacgaacttcatagttttcagctccttccaccctccagagagggttatggtccggagaccgggaggcccggcctccttgctttgattataccacgaagtttcccaattgtcacagtttattttatgaattttttggttctatgcccaatcagccgtgatgtccgcagccgtggtcatggccgccgcaggtgtgaccgccctcgtgatggtgtccgcaggtatgcccctcaccgtggtcgtggtggctgcatacggtgttgggatcgtaggccaggctgccatccagcagggcctccacctgggcgtccgcactgccggacgcaccggggtagagctgaatccccgcctcagccagggcgctgcgggcgccgccgccgatgccgccgcagatcagggtgtccactccaagtccccgcaggaaacccgccagggcgccatggccggagccgcctgtctccaccacccgggcggagaccaccttgccctccgccgcctcgtagattttgaactgctccgtatggccgaagtgctgaaaaacctgtccgttttcataggtaaccgcgattttcattttcataacctcctaattttccttggaccgcaggcacgcgccgcagccacagcgtcccataccgcaatcccgccgggcgcagtcccggccgggacactcctctccccgggggcagagcacatagtctccgccggagatgtgcaggcgcctcccctccaccagggcctgagccagcctgcgccgggcggtgtcgtacacctgctgcaccgtggagcgggccacccccatctgggcggcgcactcctcctgggtgcagcccagcaggtcgatgaggcggatggcctcgtactcctccaccgccatctccacccggccgtccgccgccccctccagggggccgaagctgctgcatcggggcagggcacagatgcgtctgcattttttgggtctgggcatagcgtctcctccgtttccggcttatgccatttattataacacgtttttggcatatgtcaataatttctttttgagtttaaccgcgtgttaatttcctttccctccacttaagatgccttttcttgttatttttttacgaaaacccacccggtttttacccttaatcagttgacacatcgtttttgtacgcattttcttgtccacccacctctgatttcggtgagtctgcctattgttttattcccatgcccatactatactttaaacagcccataaaggaggtatgatttatggtactggaattgaagtttgattccatctctgagcttgcagagctgcagcggctggccgttcaggcggataagcccgtatatattgccaatgaagacgactccatccgggtggatgcccgctcgtttttggggcttttcgcgctggactactccaagcctctgaaggtgatcaccgactccctctacgccatgcggatgctggagatccagcagcgcaaccgtgcggcccacatggcccgcgcctgagggggatacaagcaaaaaagagcggaagggcgcggcccttccgctcttttttactctttacaggtgtccatgaatttcctataataaggaatgttgtgtcacaagttgttctattgtgaggtgttggtgtgaaatctgtacttgccgaccggctctttcatctgaaggagaacggcaccacggtccgccgggagtgcttcgccggcctgaccacctttgtcaccatggcgtatatcctggcggtcaacccggccattctgggcgccgccggcatggaccggggcgcggtctttaccgcctctgctctggccgcctgcgccgctaccctgctcatggccctgctgtccaactatcccttcgccctggccccgggcatggggctgaacgcctacttcgcctacaccgtggtcatcaaacagggctactcctggcagatggccctggctgcggtcttcctggagggcctgctcttcattgtcctctccgtcacttcggtgcgggaggccatcttcaactccatcccccggcctctaaagctgggcgtcacctggggcatcggcctgttcatcctcttcatcggccttcagaactccaagctgatcgtggccgacccctccaccatgctgtcggtctaccccttccgggaggccatcgcctccggggagatgcgttccgtgggcctgggggcggtgctggccttcgccggaatcctcctcaccgccatcctcaccatccgcagggtgaggggcgccctgctgctgggcatcctggccgtgtggggggcggccatcctctgtcagctcaccggcctctatgtccccaacgccgagctgggcatggccagcgtcctgcccgacttctccgccggtctggccgtccccagcctggcccccacctttatgcagatggacttcaccgggctgttcaccctcaattttctgacggtggtgctctctttcctctttgtggacgtgttcgacaccctgggcggcattatcggcatggcctcccaggggcacatgctggatgagaacggacgcctgccccgcatccggggcgcgctgctctccgacgcggtgggcacctccgtgggcgcggtgctgggcacctccaccaccacgacctttgccgagagcgcggcgggcatcgccgccggcggccgcaccggcctcaccagcgtggtcacggccctgatgtttctcctgtccctcttcctctctcccctgtttctggcggtgcccggctttgccaccgctccggcgctggtcatcgtgggactgagcatgctcggcagcctccgggcgctggacccggcggactggcgggagagccttcccgcctatctgaccatggtggccatgcccttctgctactccatctccgagggcattgccgtgggcaccatctcctatgtggccgtccacctctttaccggcgcggagagccggaagaaggtcagccccgtgctggcgatactggccctggtctttctgctcaagtacattttcctgtaaggtacagcctgggccctgtccatacggacagggcccaggctgattatttgacccgccgaccgttgagaaagacggcccggatgctgccgttccagtcaaaggggtggccgctggtcaccaccacgtcggcgtccttgccgggggtgagggtgcctacccgcttggagaggcccgcaatctcggctgcgctgctggtgatggccgccagggcctcctccgggtccaggcccccccgcaccgccatagccgcgcaaagggggaggtactggatgggcgtttccgggtggtcggtgcagatggcgatcttcacccccgcccggtggagcagggccgggttgtccagggtctggcccaccagctccggcttggagcggtcggtgaggcagggcccggtgatgaccggcacccccgcctccgccagcagctcgggcaccagatagccctccgtgccgtgaaccaccaccagcttcagcccgaactcccggctgaggcgcacggcggtggcgatgtcgtcggcccggtgggcgtggaagtgggcgggcagctctcccgccaccaccggcaccagcgcctccagcttggcgtcgtaatcgggcatgtcctggtcgggatctccgtccgccttggcctgcttgtcctggtactcctgggctttggccaggtgctcccggatgagggccgcggtggccatacgggtcaccggcgtctccttccggtcgttgtagaccgacttgggattttcccccagggcaaacttcatggcggcgggggccttgagcaccatctcgtccacccagcggccgtcggtcttgagggccaggaactgcccggcgatggggttggccgagccggggccggtgagcaccgtggtcacgcccccctcccgtgcctcccggaagccccggtccaggggattcactccgtcgactgcccggagctggggggtacaggggtcggtggactcatttccgtcgtccgcctcaaagcccagggcatccccgaacaggcccaggtggcagtgggcatcgataaagccgggcaggatatgccccccctccgcatccagcacggggccctccgccccggcgggcagggcctccatgggccctacggcggtgagcttctccccctcaaaagccacgaagccgcggggaatcaccggcccgtccatggggtgaactaccccgttgagaatcagcattagccattcgccgcctttcgacaaaagttctatttgacattttatggaaatcatagtatgataagagcacagcttatccaataggcgagtgtaattccaacccgcgattcttccattctcccgcacacatctctcttgggcgccccaggacggggcgctctttttttatctactcctccagcgtgtactggtccaccagggccacgtcccgctccaggtagtggccgccgcgccagaggcggaaggtgagcacgtcccccaccgccagcccctccttgatcgcctggagctggtccatgtcggtgatcgtctcgccgttgaccgccacgatcacgtcgttgggcaggacgccctgccgttgggcgtcggagcccccccggacgctctgtaccgccaccccccgggggcacccgtacccctccgccagctcctccgtcacggtatagccggtgatgccgatggtgggctggccctccacccgcccgtgggcgatgagggcatccaccaccgtcttgaccgtggtggtgggaatggcgaagcccaggccctctaccgtgttgtcataggcccgcattttcaggttggtaatgccaaccacctgtccccggtcgttgatgagcgccccgccggagttgcccgagttgagggcggcggtggtctggagcagtaccatggtgtacccgtccacgttcacatcccggttgatggcggagatgatgccgtcggtcatggtgccccgcagctcctcccccagcggattgccgatggccgccaccgcgtcccccacctccagaagggtggagtcaccgaactgggcgggcgtcaggccggcgcagtcaatcttcagcaccgccagatcgctctgtgcatcctgtcccaccagcagggcctggaacacacgctcatcctggagcaccacatccacggcgccgcatccctcaatgacgtggctgttggtgatgatatacccgtcctccgacatcaccacgccggtgcccaggctcatgccgtcccccttgctcccccggatgctgacgatggaggcgatgttctcccggtaaatctcctggaggctgtgggccccgccgctgggcaggggggagatggtgagggtggtgccgtccccggtgggggcccgctctaccgtggtttcctccggcagctcctcccggacgggaaggggctgccaggtgctgtcggccagggccggcagctcctccaggcggctgtggctccacagccccgccgccgcagtcaggccgcccagcagggccatggtcaggagaaagaggagcaccgccgctgcgccgctccaccgccggcggcgccctgcggaaatcggcgccggggtgctccggggggcctcccccgtttgatcgtaatagtagccgcgcatgggtcctccttcttgccccgtccgccggggcgtcatgcaagcgtcagggtaaatacgaactccgtcacgccgtcctggctggtgacggaaatgttctccttgtggttgttgaggatagtcttgacgatatacagccccaggcccacgccctcccggtccacggagcgggatttgtcgctcttgtggaagcggtcgaagatcatggccagctcgtcgggggggatggtgtcgccgtggttgcgtaccgccacgtgggccttgccccccttggcggtgatggacaggcccatggtgctcccctcggccgagaacttgatggcgttgtccagcaggttatagcacacctgggtgatggcatccggatccccccacaccagcacgggcccgtcggggagctgggtgtccacgtccagatggcgggcattgatcttgttctccaggctcaccagcacccgcagcatgacctcggacacgtcgaactgctcctgggcggtgacattctccgccgactggaggcgggacagatccagcatccgccgcaccaggcgggagagccgccgggtttccgaggagatggtctgtagggcggcgcgctccttgtccggcgggatggtgccatccagaatgccgtcggaaaagccggcgatggtggtcatgggggtcttgagctcgtgggagatgttggccacaaactcgctgcggcgggcctcgctcttggcaatggagtcggccatggcgttgaaggcctcggccagctcgcccacctcgtccttccgcttctcatagccctgcacccgcacctcgtactcgccgtggccgaatttgcgggcggtctcggcgatctccttcagggggttggtcagccgcagggaggtgatggagctggtgatgaaagccacgcacagtaccaccacggcggtaaagaaaaagatggagatgaacgcctgccacagctcggtgatgtccgaggtctccgccgccacataggccacgccgatcatggtctgctcggtctgcccggtggccaggttcaccgttttgaccgtgatgggggtgcccgccacaaagcgtttctccggaaacaggccgcccagagtggtcataccgctgtagccgccctccttttggagctggctgacgatggactggggcagatagttcccccccagcccgctctggattgtcgctccatcggaacagagtaccagctccccatccgcctcggtgaccaggacaaaggcgttggcgatgtgggccacattggcaacatagagctggtaggccatgtcccgcacgtcgatcccttcggcccgcaccttggcggtgaagtcggccacataatcggcgttgcgctccatggagtctcgggtttcccggattgtatactggtaggacaggccgataaaggcggtccccagcagggcgaaggagatgagaatcatccccgccgtcagcaggaactgccgtccgtacaggctcttcatgcgccgctcacaacctcaaacttgtaaccgacaccccacacggttttgaggctccactgctcgctggccccccacgaagcgttccgctccgcggggaccccatttcctttccatttttcgcgggccggaagtgaattccgtcccgctccgccgcagaggcggcggcacgccttgcgtgccggcgtcagcgcatatgccctcatccgttcaccacctcgaacttgtaaccgacaccccacacggttttgaggctccactgctcgctgacgccctccagcttctcccgcaggcgcttgatatgcacgtccacggtacgggagtcgccgaagtagtcgaagccccacacctcgtccagcagttggtttcgggtgaatacccggttgggggaggccgccaggtggtagagcagctccagctccttgggcggcgtatccacccgcttgccgtccaccagcagctcataggagtccaggttgatgaccagcttgtcgaaggtgagcttcttctcgccgctcccctcctcctcgccgccgaagcggcggagcaccgcgtggatgcgggccagcacctccttcatctcaaagggcttgacgatatagtcgtcggcgcccccctccagcccggccaccttgtcctgggtctcccccttggcggtgagcatgatcaccggggtcttgtcgttctcccggatcttcttgagcaccgaccagccgtccattacaggcagcatgatgtccagcagcaccagctccgggtggaaggagcggaacagctccacccccttgccgccgtccccggccaccgctgtctcaaagccctccttctccagatagaggtggagaagctcggcaatattggagtcgtcttccacaatcaggaccttcctggccatagcgcaccgtccttttctatgttgttctctccggtattataccggctttttcccccacaagggtgaattttttgtaaaagggggttaccgggtctccacataggcccggtccacctgaatgaccgcaaaataccgctcgtccagggcgcgcaccgccccggacaggcgttcacagagctcctcgtcccgcaggcggcagcggtggggcaccaccacgtcaaaaatcaggttggtgtgctggggccccttggtcacccggaagtcatggatggtcatctccggctccacggcccttgccagggccgccacctgttcccgcaggcggttcaccgactcgtcgtcggtggcgatggggtccatgtgcgccgtggtctcaatgccgaacttctgctggatctcccgctcgatgtggtcgatggcgtcgtgggcctccaggatgtcggcgtcctggggtacctcggcgtggaaagagcacagccgccgccctgggccgtagtcgtggatgatgaggtcgtgcattcccaccacctggggatgcgacagcaccacctcccggatcgcgtggaccagctccgggtcggggcgggcccccagcagggggttaatggtgtccttggcggctccccaacccgccttcagaataaagacggccaccaccgcccccgcccagccgtcgatgctcaggtgggcgaagtgtccggccagggtgcccgccaacacggcggaggtcgccaccacgtcggagagggagtcggcggcggtggccgccatggccgccgagccgagcttcttccccaatacccggttgaaatggctcatccacagcttcaccaggatggaagccgccagaatggccaccgacaccagcgaaaagtccaccgcctccgggcggaggatcttcccgatggaggtcttgcccagctccagccccaccaggaggatcatcaggctcaccagcagccccgccaggtactccgcccggccgtggccgaaggggtgtccatcgtcggccttctgtcccgccagcttaaagcccaccagagtcaccaccgacgagcccgcgtcggacaggttgttgaaggcatccgccgtgatggcgatggagccggtcacaacgccggcgaagaacttgcccgcagacagcagcagattgagcacaatccccaccgccccggacaggacgccgtacttctcccgcaccgccgggtccgtcacattgtcgcagtcctggatgaaaagccgcaccagccgattgatcatgctgtctcccccaaagattggtttccttttattatcccacgcccgcccgccatcgtcaaggagaggttttccccccaaacagacggtcttcctccctctccttgtatccacaggtacaaagtgatagaatagggaaaacaagctccccatacccaagccgccgtggcgaggaggtatcctatgaaaatccgttttctcgagccgggcaaccggccctacaagcccacgcccctcaactacttcgtctacgaccgctacatccgtaccccctccgtgggactcaacaccctggccaccattgtcaaggagctggtggacgacacctatatgtacagcgagtccatctcccgcatcgacatggccgacgtggaggacgcggacatcgtgttcatcggtattttcaccttcgccgccgtccggggctacgagctggccgaccacctccgggcccacggacggggcctggtggtgctgggcggtctccacgcctccatgaactgcgccgaggcggcgcgccactgcgactatgtgctgctgggcgagggggacgagaccatccgcgccttcgtggatgcggtgggccgcggggagcggccggacttccccggcttggcctggatggagggggatgagctgcgctccaccggctatccgcccccgccggagcgcttcgagacgattgcagaccgtaatttagtccacaattattccaaaatggtggggcacagcaccctctggccccaggtgcacgcctcccggggctgcccccataactgcgactactgcgccctggtacgccacttcggccgccgcgtccgcacccgttcgccggaaaatgtggtggccgacatccgggagtccatccgcttcttccaccggggccacgtccggctggccaaagatctctggctcaccgacgacaacttcttcgccgaccgggactgggccatgtccgtcctccgggccatcgtggacagcggcatccgctaccgcttcaacgtacaggcccggtacgaggtaggcttcgacgacgagatgctcgatctcctcaggcaggccggcttcttcgagctggatctgggcatcgagtttctggacgacgcctccttcgccacctaccacaagaagagcacccggcaggagatcatcgacgccatccgcaacatccgcgcccacggcctcagcgtccgggggctgttcatcctgggctccgacgaccaggaggcgggcgtgggcgaccagctggccgacttcgtcatccagaaccacatccagggcaccctgatccagtgtatgtacttcgtccccggcacgccggtatacgaggccaaccgggaccggctgctccaccaggactggtcgaaatacaacggcaacgccgtccacttcccccgccgcatgaccccctaccagctccaactggagcacatccgggccagccggaaaatctactcctggcggcggctcttctccgccctggtgcgggaggaccccatccacaagctgctctttttgggggaatttttctggcacatgagcgtgcgcagcgatctgaaaaaggagctgccctacctcaagcggatctccgaacaggccgcgtgcgcgcctcactagaggcgcgcacgctttttcgtaccatatcatgttgtggctacggggtgcggagcagctccttccgctcgctctccagaccggcctgccgtccggccagctcctgatccatccgctccagattccgcagcgcgttgagcacccggacatgaacctcggacacgccttcctgggcgtcctggattttggactgtaccatccagtccatgaaaaaaccgtcgaagaagtagtcggcaaaggtggcgaactccccgatctgtacctggggaagctccatgtcccgcacgtcggccagctcggtgcggaagcgggacagggcccgttgggcgtggtcgatgcccgcccgggcgtcgtcgatgtgcccgtgcttggccatagtggtaaacagcccgccccccagcatgtcccaagtcccccagctctcggcgctgtccaggctgtccagcacgccggacagggcctgctctgcctgccggcccgcgtgaagggcctccccaacctcccggcgctgggccgccagcgcatccagcgcccgatccagctccgccaggcgggttcccccggtgccgcccagctccttcaagcgctccgctttctctcccagcagagcttccagccgtgtccggacggcccgcagctcctcccgcccctggagcagatcccgaatccgctcctccagatcctccgcgtcccgccgggcctggtcatactggagccgggcggccagctcctcccggcgctcctgggacagccgggcctccctgtccccggtgagggagagcagcagggcccgcaggccccccttctccagcttttccacgtcctcccgctccttggtcagaagccgggcggtctcctccacccgggccttccgctcctcatactgcgcccgcagatcgtccagccgccgctccagcccatttgcccgggccagccgtccgttcagctcgctcagctcctcgttgagttctctcagccgctcgtccatgccgttcccctccttttcttttattctacggcttcagaagggaaagcgcaaggaaatccgctggacttccccgtcaaattcgcgtaaaatagccttattccaatcccacaaggagcgctgatatggacacaatcattcagatactggcccgggagctgggccggagcgaggcccacgtggagaacgtggtgcgcctcattgacgagggcaacaccatccccttcatcgcccgctaccgcaaggagctccacggggccatggacgataccgccctgcgcaccctggccgaccggctgcaatacctgcgcaatctggacaagcggcgggaggaggtcaagtccgccatcgagggccagggcaagctgacggaggagctctccgccgccatcgacgccgccgccaccctggcggaggtggaggatctctaccgcccctataagcagaagcgccgcacccgcgccaccgtggcccgcgaaaaggggctggagcctctggccgagctgctcttcgcccaggccgcggacggccccgcgccggaggaggccgccggcgccttcgtcgacccggagaagggggtggagacggcggaggacgccctccagggagccagcgacatcatcgccgagcgcatctccgacgacgcggacatccgcaagcgcctgcgggagctggtgtggaaaaagggatatctggtctccgccgccgcggccaaggagccggaggacaccgtctaccggctctactacgccttccgctcccccctgaaccgggtacagggccaccaggtgctggccatcaaccgcggagagcgggagggcgtgctcaaggtgagcgtggagatggagcgcgaggcggccctgatccccgtccgccgggcggtgctgaaccccggcgcccccgccatggccttcgtccgcgccgccgccgaggacgcctacgaccggctgatcttcccctcggtggaacgggagatgcgcggcctgctcactgagcaggccgacgagggggccatcaaaatgttcggcctcaacctcaagcccctgctgatgcagccgccggtgaagggctttgtcaccatggggcttgaccccggctaccgcaacggctgcaaggtggcggtggtggacgccaccggcaaggtgctggacacggcggtggtctaccccacgttcagccagcggaagaaggaggaggccatcgacgcgctggcaaagctcatccgccgccacggcgtggcccacatcgccatcggcaacggcaccgccagccgggagaccgagcagatgacggtggagctcatcaggcggctgggcggcggcgtcagctacatgatcgtcaacgaggcgggggcctcggtctactccgcctccaagctggccgcggaggagttccccgactacgacgtgaacctgcgaagcgctgtgtccatcgcccggcggctccaggatcccctggccgagctggtgaagatcgaccccaagagcatcggcgtgggtcagtaccagcacgacatgccccaggcacggctggacgagaccctctccggcgtggtggaggactgcgtcaacgcggtgggggtggatctcaacaccgcctccgcccccctgctgtcctacgtggcggggctgaacaacaccaccgccaggaacatcgtcaagtaccgggaggagaacggggccttcaccacccggaagggggtgctcaaggtgcccaagctggggcccaaggcctttgagcagtgcgccggcttcctgcgggtaccggagagccgcaatgtgctggatcacaccggcgtccacccggagagctacggcgcggcggaggcgttgctcgccctgtgcggctacggcctgtccgacgtgaaggccggcggcctggacggtctgcgggagcgggtggccgcatacggcgaggagaaggccgcggaggtatgcggcgtgggtgtacccaccctgcgggacatcgtgggcgagctggtgaagcccggccgggacccccgggacgagttgccccgccccattctgcgcaccgacgtgctggagatgaaggatttgaagcccggcatggagctcaccggcacggtgcgcaacgtcatcgacttcggcgtgttcgtggacatcggcgtccaccaggacgggctggtgcacatctcccagctccgggagggccgccgggtgcagcacccctccgaggtgtgcgccgtgggcgacatcgtcaccgtctgggtgctggaggtggacgagaagaaaaagcggatttccctcaccatgaagaagccaaagggctgaaccggccttgacaggccccgccgcaggcgggacgcggcgcatgccgcgccaagcgttccggccggcaggccggaaccttgaactcgcccgaattcacttcgggcgggttgagtgaaatgaggggcccccgcgcggccatggccgcggggggcggcgagaagaaaaagcggatttccatcaccatgaagaagccaaagggctgaaccggccttgacgggccccgccgcaggcgggacgcggcgcatgccgcgccaagcgttccggccggcaggccggaaccctgaactcgcccgaagtgaattcgggcgagttcagggaaatgaggggtccccgcgcggccatggccgcggggggcggcgagaagaaaaaacggatttccatcaccatgaagaagccaaaagggggagcggtatgattctcagctttgacgaggcgggcgcgctgctggacgagatggcggaggagttcccgccggagttctacgacgagctcaacggcggcatcgccctgctgcccgaggccaaggaagacccggagggggagcacggcgagctctacatcatgggcgagtactgcaacgacatgatgggcaaatatatcaacctctactatggctccttcgccgccctggccgggcaggaggactggacggaggaggactgggaggatgagctttacaccaccctggcccacgagttcacccaccacatcgagggccgcgccggggagcggggcctggagcgcaaggacgagcagttcatggaggagttccgcgccgggcgcggggaatagccgcccggcggcagacgaagcaaggcccggcggacgcaaacgcgtccgccgggccttttcctatattccgttcacccgtgctggggcaccaccgcgaagaactccagcgtctgtgtcccgtcgttgaccagggagtgggcgtgcccctccgggcagtagtgacagtctcccggggccagacgctcctcgccgccgccgtacagggccttacccgtgccggagagaacgtacacaatttcgctgctcccctcgtgggtgtgcaggccgatggagcaccccggctccagccgcccccgcatgatgcggttgcgcccgtccgcaaacatcctggcgtgggtcactccctcgccgcccttgaacccgaggatggcagtctcctctatgactccgaattccaccttcattccaactcctcctctgactacagcagcgatacgccgaaccggcccgccatatcccgcaggccctcctccagctcgtcccggccgaagcccgccgcctccagttgggcgtcggtcaggtcgttgagccgggcatagaagtccaccgccagctccagataacgccggtcgccgggatcgctctccgcaaagagcagatcctccgccccgccgatgtccccggcgttgaccttctccagcaggcggcggtggagctcgtccagcgcggcgtcctccgccgtcccgccgggcacatagtcggtggaatccttctgaaacaccagataggcaatggagcgggccagggcgtccacctggcgcatcatccaatcctcggtcagcattccgcatctctcctttttatagttcccgcaccaagcgcaccgccacgcccacgatgcgggccgcgccggtctcaaaatccgacagggggaccagcttgggctcatagacggggttctccggctggagaagcaccatgtcccgctggcggcggaagcgcttgagggtggcgtcctccccgtccaccaggcaggccacaatctggccgttctctgccgtgtcctgccgccgcaggagtaccagatccccgtcccggatgcccgcgttcaccatgctgtcgccggtgacccgcaagtaaaaatagccctccggatcgggcacgtcggcgtgggcccatccctccctccgctgctcggccgccatgggcagccctgcccggatggtgcccaggatggggacggactgccgctgtccggtacggcggggcacatcgtagcccaacagccacagggggtccacacccagggcggcggccatggcggaggccgtgccgattttcggctcccgctggcccagcacatagcggttcagcgtctgcgggttcatccccaggcgctcccccagctgctcatagctgagtccctcttcctccatcaggcggcgcaggcggccgccaaggctgctctcccgctccatctgtccgtccctcctgtcccattattggggctatcctatcatattttatcaccatttgcaacagaaaccaggaaaaaacccttgactgttatctccatttggtgttattataacctcgtaatcgaacataagttctatttcattcgttcagtatcaccatttggagatcccagatgcgaaaaaatgccccgccgactggcgagacattttttggtggaggagggtggattcgaaccaccgaagcgaatcgcaacagatttacagtctgccccctttggccactcgggaactcctccgtatgaacttgttggagctggtggacggactcgaacccccgaccggttgattacaaatcaactgctctaccaactgagctacaccagcataccagctcgtccacagcgaaggttagtttaacagacacggagggatttgtcaagggaaagcggtatatttttttacaaatttttttcgggaggaatgcgccatccagccagaggtatgggcggatccgctgcgggatgtgcagcgggttccgccgcggggctggtgcccccggtgccgctcagagctctacagcggggagcggggactctgtcccgcctgcctggccgagctggagcgcggccgcacacaacaagaggaggagaacagacacacaaatgaccttactggaattatcgggcgaataccgcgccagtgccgccgccctgcgggagcgggtgctgctcctggagcaccggctgagaggggcggacggggatggacgccgtctgctggaggggcgtatccggctgctgcgcgccatgggccgggaggcccgggagctggccgtcctgtgtgagcgctactacgagagggggtactgccgcaatggcaaatacacgctataggcggggcggggcctacgccgccgacatggcggtatacgcccgcgccatggccgccgataactccgcccagctcagccgggtgaaacgcaacctggtgcgggcgctgcgggaggacgtgactccccgccagcgggaggtgctgctgctctactacgccgagcagctcaacacccgccagatcggggaaaagctgggggtggacaagtccaccgtagcccgcaccatcaagcggggggaggcccggctgcgccgctgcctgcggtacggcgcggaggcctttctgaacgcggcggcggagggaccgccctgatttttctacacccacggagtgggtgaaaggttgaatggccggccgttccgtggtatactgtctcccgaatgaaaatcgccgtttttcgcaaagggaggccgaggcattggaacttaatctcacacagaagcaggtgcagaccctgtccccccaaatgatgcagtccatggagattctacagatgggctcccaggagcttctggaatacatcgaggaggcggtgcaggaaaacccggtgctggagccggaggagacctatgacaagcaggacgagttctccgtcctccgccgcaagctggagtggctggagtccaccgacccgcagaaccgctactaccaccagcaggacaccgaggaggaggacagcccccttaacaacttcggcaccgtacaggacgacgacgagaacctctactattatgtcctctcccagctccgggtactggagctggagccagaggtgatggacgccggggtgttcctggtggagagtctcaatcagaacggctggctggacgagcctctggaggccctggctgccggccacggctgcgggccggaggtgatggcccaggccctggaggtggtacagtccctggagcccgccggcgtgggggcccgggatctggccgagtgcctcaagctccagctcgtgcgccgcacgccggtgaacgagctggcggtacgtattgtggagcgccacctggacgccctgtccaagagccgctacggcctcattgcccgggaactgaaagccagtcctgaggaggtgcgtgccgcctgcgacgtgatccgctccctcaacccccgccccggaaccggcttcgccgcccgggagaatctaacctacatcaaccccgacatcatcgtggtcagcttccccgaccacttcgagctgctgaccaatgactattacttccccaccctcaacatcagcggatactacacccgcctgatgaaggagagtgacgacagccaggtgaaggactatctgaccggcaaggtgcgccaggccaagtggatggtcaaggccatcgagcagcgccgctccaccctcatggcgtgcgccgagtgtattctggaattccaggagtcctttttccgcaaggggcccggccacctggttcccctgtccctggccgacgtggccgagcgcatcggcgtccacgagtccacagtgagccgggcggtaaaggagaagtatatccagtgctccatgggtgtctatcccctgagctactttttctcccgcagcctgggccccgccgccggcgacgaggccgcctcccccgacgcggccaaggcgctgctgaagaagcttatcgccggggaggacaagaaaaagcccctgtccgaccaaaagctctgtgagctcatgtccgcccagggctgctccctctcccgccgcaccgtggccaagtaccgggacgagctgcacatccccagcaccgccggccgcaagcaatatgaaacgtcaggagccttctgagcgatgaactttaaagctgtcttttttgatttcgactacaccctggccgacggcaccgaggccattgtggccgggttccggtacgcctttgggcggatgggcctgcccgagcccacggaggaagccatccgccccaccatcggcatggttctggaggacgagttcacctttctctccggcgaggccgaccccgcccgccgggcagagttccggcagctctacaccgagaaggccggccccatgcatgtgtccgtcacccggctgtttcccggtgcgctggagctgctcaccgccctgaagcgccgtggtattcccaccggcattgtcagtaccaagaagaccgccaccatccgcgacgtagcggaggccaggggcattactcccctgctgtcctccattctgggcggcgaccaggtttccgcccccaagccggacccggagggactcttggcctccctcaccgccctggggctggaaccccacgaggttctgttctgcggcgacaccgtcatcgacggggaggccgcccggcgggctggcactcacttctgcgcggtgctcaacggcaccaccacctttgaggaattccagaccagacgcatcccctgcgaccacgtggccggggatctctgggatctcaagcagtggctgggcctcaactgaatcaaatgtccccgccgcaaagcggccgcccgacgggcggccgcttttttggtatccatttttgtaaagccgggaatcctatgagggagagcggctttacacactctttacaatccgttgaaggacaactttacaatccgtctgtatactgataaccgttcccgaaggcaaccaaaacgatgcatgattggagaatgaatgtcatgaaaaagagaacccttgctctgatgctctccgccgccctgtgcgtcggcctgctggccggctgcggcagcggcaataacgatcccgtcaatactcccgccgccggcggcagcgagaccccctcgcaggaatccaccgcagccctgagcggcaccgtcaacaccaacggctccacctccatggagagcgtgatgggctacctgaccgagggctttaaggaggtgcagcccggcatcacggtgaactacaccggctccggttccagcgccggcgtcaccggcgcccaggacggcacctgcgacatcggcctggcctcccgcgacctgaaggatgacgaaaccggcgtcaaggccatcaccgtggccaaggacggcatcgccatcatcgtcaaccccaacaaccccgtggccgacctcagcgtggagcagatcgcccagctcgccaccggcgagatcaccaactgggccgacgtgggcggcacggacggccaggtggtcttcatgggccgtgaggccggctccggcacccgcgacggcttcgagtccatcaccggcaccaaggacgcctgcaagtaccagaatgagctgacctccaccggcgaggtgatcgccgccgtggcctccaaccccaacgccatcggctacgcctccctgtccgccgtggacgagaccgtgaaggccatcaccgtgggcggcgtggaacccacggaggagaccgttctggacggcagctacgccatccagcgcaacttcaacttcatcgtcagtgacagcaccccgctctccgaggccgcccaggcgttcgtggacttcgccacctccgccgatgcctccgacctgatcgccggcgccggcgctgtgccggtagccgagtaatccgtccctctcttccggatcgccccctcgagcccgagggggcattcggcatgattacatcattacgaaaggccggttatttgccatgaaacagaagctccgaccgctggaagtctttatgaacctcctgttttttgtctgcggtctgatcgcggtcgtctttgtcctcttcatcagtatctacctgatcgtgtccggcctgcccgccatccgcgagatcgggctggtggacttcctcttcggcactgagtgggcctccaccgccgccgagcccaaattcggcatactgcccttcatccttacctccatctacggcaccgccggggccattgtcctgggcgtaccggtgggcttcatgaccgcagtgttcctggccaaggtagcgcctccccgtctggccagcctggtgcgcccggcagtggatctgctggcgggcatcccttccgtggtgtacggtctcatcggcatgatggttctggtgcctgcggtgcgggtggccttccacctgcccgacggcgccagcctgttctgcgccattctggtgctggccgtcatgattctgccctccatcatctccgtatccgagactgccctcaaggcggtgcccaaggagtacgaggaggcctcgctggccctgggcgccacccatatcgagaccgtgttccgggtgagcgtcccggccgcctccagcggcatcgccgcctccatcgtgctgggcatcggccgggccatcggcgaagccatggcggtcatcatggtggcgggcaatgtggccaacatgcccggtctcttccagtccgtccgcttcctcaccaccgccgtgtccagcgagatggcctacgcctccggcctgcaacggcaggccctgttctccatcgccctggttctctttctcttcatcatgctcatcaatattgttctcaatacgcttctcaagcggaagaaggggtgatatactgatatggaaatgaagcctctttccggccggcgcagagcctatgaccggattctccgctttctcctctacttctgcgccgccctgacctgcgccctgctactcttcatcatcggctatatcttcttcaagggcctgccccatgtcacctggcagttcctcagcacccagcccagcttcatcaaggacaccatcggcatcctgcccaatatcctcaacacagtctatctcgtgggggtcaccctgatcatcaccctgcccctgggggtcggcgcggccatctacctcaccgagtacgcccgcaaccgccgcctggtggccgccatcgagtttgccaccgagaccctcaccggcatcccctccatcatcttcggcctggtgggcatgctctttttctgccagcttctggggcttcaggcttccctgctggccggctcgctgactctggtgatcgtcaccatcccaaccatcatccgcaccacccaggagtccctcaagaccgtccctcagtccttccgggaggcggccctgggcttgggcgcgggcaagtggcatatgattcgcaccgtggtgctcccctcctcagtggacggcatcgtgacgggctgtattctggccatcggccgcattgtgggcgagtcggccgccctgctcttcaccgcgggcatgggcatgagcctgaacaactttttcggctcggtgggcaacttcatccactcctccggcgcctccctcaccgtggccctgtatgtgtacgcccgtgagcgggctgagttcgacgttgcctttgccatcgcggccattctgatgctgctcaccctggtcatcaacctcagcgccaagctggtgggcagaacattaaagaaaaaataaggagcccttaccatggacgaaaacatcatcctctccgccaagggccttgacctctggtacggccccacccaggccctgaagggcgtgagcatggatatccccgaaaagcaggtgaccgccctcatcggcccctccggctgcggcaagtctacctttctcaagacactggaccgcatgaacgacctggtgcccggcatcaagatcaccggctcggtgcagtaccgggggcaggagatctatgcccccaatgtggacgtaacctggctgcgcaagcagatcggcatggtgttccagaagcccaaccccttccccatgtccatctatgacaacgtggcctacggtccccgcacccacggcatcaagagcaagagcaggctggacgacatcgtggagaagtcccttcagggcgcggccatctgggacgaggtaaaggaccgcctcaagaagtcggccctgggcctgtccggcggccagcagcagcggctgtgcatcgcccgcgccctggccgtggagcccgacatcctgctgatggatgaggctacctccgccctggaccccatctccacctccaagatcgaggatctgattgccgatctgaagcagaaatataccattgttatcgtcacccacaatatgcagcaggccacccgcgtgtccgacaagtgcgcctttttcctgctgggccagctcattgagtttggggacactacccagctcttctccatgcccagggacaagcgcaccgaggattacatcaccgggcggtttggttaaaaaggaggccccatgagaaagacctttgacgcggagctccaggagctcaactatgaaatgatcgacatggcggcggcggcagaggacgccatcgacgtggtcaccgagtccctggcctccggcgacgacgcggcggccaagtccgccgtggagatgacccgcagcatggaccagatggagcgggacattgagaaccgctgcctgcgcctgctcctccagcagcagcccgtggcccgggatctgcgcaccatctcggcggccatgaaaatggtcaccgatctacagcgcatcggcgaccagtgcgccaacatcgccgagatctccctgctgctcaaggagcagaagcagacccgcaccctggccgacatccgcaccatgagccagaaggccggcgtgatggtcaagcgctccatcttcgcctacgtcaaccgggacaccgaggccgcccaggctgtcattgccctggacgacgaggtggacgccctcttccgcaccatcaagggggagctggtggagctcattgcgggcaaccgggacgaggccgaccaggccatcgacctcatcattatcgccaagtacctggagcgcatcgcggatcacgcggtgaacatcgcccagtgggccatcttctgtgtgaccggcgaaattctcgggtaaggaggtgtccccatgtccaaggccattgcggtcgtggaggacgacgagagtatccgtgagatgctccgctattattttcaatcggtgggctacgccgtccgggcctacgagtccggcgaggccctctttgccggcgaggagggcctcggcctgcccgccctttacatcctggacatcatgctccccggcatggacgggctggagattctccgccgcctgcgggaggggcgggacactgccgacgtacccgtgatcatgctcaccgcccgctccgccgagatggaccgggtggccggcctggaaaacggcgccgacgactatgtggtgaagcccttcggcatcatggagctccaggcccgggtcaaggcggtgctccgccgcaccgagcgccggggcgaccgggtactcacctggggggacgtggaactggaccccgccgcccgggaggtacacaaggccggaaagccggtggagctgacctacaaggagtttgagctgctcaagctcctgttttcccgccggggcgtggccctcacccgggacgagattctccaggccgtctgggactacgactacaccggcgagacccgcaccgtggatatgcacgtcaaggccctgcgccaaaagctgggcgaggacatcatcactacagtccggggcgtgggatataaaatggtctgacggcctccagggggttgcatcccccctgaatacgcggccgccgcgccgaccggggcggccgcgataccccctcacccgcgcacggcgcgggtggccgcccgccggcggcggagcgggcagctgtgtcctccggcgaagtacccgcaaggggcacaccatatccgtaaggcagcaaagccgccaacggctatgcagtaaattcgccttcggacgttctgatttcttttcacccgcggggcgggtgaagcactgcgaggcggccccgcaggaaacacccgattgggaggtctgaccagtgaaaaaacgcatcatcggcgccacactcatcaccgtggtgtgcgccctgctcatatccaacctagtgggcgtgctcctgttccgcagccgggagatggacgccgcccgcaacacccttcaggagctgctggtgctgatggacgctcagagcgccatcaccgatcccgacggcctggcccagcagttccacgccgccgcgccggacaagcggctgaccatcatcgacaccgacggcaccgttctggctgacaccgaggccaacccccagacgctggaggaccacaacagccgccccgaggtggagcaggccgccgccaccggctggggcgaggcggtgcgccactccgaaaccctgggcacctccatgctctacgtgtccaagcgctttgccgacggcatggtgggccgggcctccatgcccctgtcctccatcgacagcctggtgtggaacggcgtatggggcttcctcatcgcctcggcggccggactgctgctggccctgattctggcccgccgcaccgccaaccgggtggtggccccactcagcgccgtgggcagcgccctccagagcgtgctggacggcacccgcgcctccggtctggaggattaccaggccgacgacgagctgcgccccatcctgcgctacattgacaagctgatggagcgcctgggcggctatattcagtccatcaccgcggagcgggacaaggtgggcctcatcctggactgcatggacgagggcctcatcctgctggacgaggcgggcaacgtgctggccatcaaccgggcggcccgcaccctgttcggcttccccgatggggaggaggacgacggcgccctgctcctcacccgcagccgccgcctgcgggaggccattcaggagtcccgcgtccgccactcctccgtggtgctggacgtggatgccctcaccgaggacgcccagagcctgcgcctgtttgtctcccccgtctccggccgccagtatgaggggcaggccgtgggcacgtccatcctcatctccgatgtcaccgagctcaagaaggccgagggcatccgcagcgagttcaccgccaacgtctcccacgagctcaagacccccctcacctccatcaagggcttcaccgacatgctggcctccggcatggtggcctctcccgaggatcagaagcgcttcatcaccatgatcggcgtggaggtggaccggctcatcgacctcatcaacgacattctcaagctctctgagctggagtcggtcaccatcccccagagcgaggagcgctccgacgtgctcaccatcgcccgggacaccgccgctttcctcacccccaccgccaaggccgcggaggtcaccctctccgtagacggcggtcccgccaccgtggccgtcccccagggtcggctcaaggagctgctgctcaacctggtgggcaacggcatcaagtacaatgagcccggcggcaccgtgcgcaccgccgtctccgtccgggacgggcaggccgtcatcgccgtgtccgacaccggcatcggcatcccccccgaggcccagagccgcgtctttgagcggttctaccgggtggacaagggccgcgcccgcaagaacggcggcaccggcctggggctggccatcgtcaaacacatcgtccagctctacggcggcaccctgacgctggagagcgcggtgggcaagggctccaccttcacagtgaccctccccctggccaaggacaacgcctgaaaaaagggcggctgaacattcagccgccctttttctgcgcctcggagtagcggtggcaggcgggcgtatccgtctgcttgtaccggatgcggggttctccgcagtggcccagcttgatgggtatgtaccaattccgccccctttttacatagtgccggcgaaaatgtcggcaggtttcacaggtcttttccccgtccattgcaatcacctccttacataatatataccattaggtcaccatatgcaacccacttgtttaaaaaaagtggtaatgttatagtacctatataggaggtatttaaatggctgaatctgttttggtaaatcgtaagaagtttatatcttctcttgacaacaaattggttgagccattgaatgcgctctccaaaaagactcgtgttccaaaatctcggcttctggatgaggcaattgaagatcttttaaagaaatatgaaaaaaaggacggctgacagttcaggcgtcctttttcgattcccggcattttgcgtaggggctgacgccccagggcggcctctcttgcacctattggcctgtgcattcgcggctcagtaggggcggcctttatggccgcccggcctgctccgtaggggccgatgcccacatcggcccgccttattccgggctgaaacgccttccatgggaacctttttcgtatctgttttcttgtcatgcctccggcgggcccctttctgagtggccagaaaggggcgaaagagccagccgggaaggggggatttcgatttccccccttcccggcacccatcccccttaaaacgaccaaagagggggccttcgggcccccatctttggaatctcccccaagttgttctaccgatagcgcaccggcggcgggggcttactccgtaacgcccccgccgcaccggcctgtatgggaggaaaccggaagacggtgctgggacataggagcgggcttgtccccgcccgcagatggttcccccgtgtaggggccgatgcctacatcggcccctacgagagggcggcggcggcaagcccccgtaggggccggacactggccggtctttctctgccataccttccattccacacacttgtaggggcggcctttatggccgcccctacccctggcaaacaatcaggccccggcgtccgcaccgaacggtgcggacgccggggccaatttgacatagattagaactccgcgttgcccacggtgcgggggtggggcagcacgtcacggatgttggagattccggtcaggtacatgaccatgcgctcaaagcccaggccgaagccggcgtgcttgcagccgccgtagcgccgcagatccaggtaccaccaatagtcctcggggcgcatgcccagctcctggatgcggccctccagccgctccagccgctcctcacgctgggagccgccgatgatctcgccgatgccgggcaccaggcagtcgcaggcggccacggtcttgccgtcgtcgttgaggcgcatatagaacgccttgatgtccttggggtagtcggtgacgaacacgggctttttgaagatctgctcggtgagatagcgctcatgctcggtctggaggtcggtgccccactccaccttgtagtcaaatttgtcgttgttctgtttgagcagctccaccgcctcggtgtagctcacacggccgaagtcggaggaggccacatgctccagccgctccttgaggcccttgtccacgaaggagttgaagaagttgatctcgtcggggcacttctccatgacggtgcggatgatgtgcttgatcatggcctcggccacgtccatgtcgcccttgaggtcgcagaaggccatctccggctcgatcatccagaactcggcggcgtggcgctgggtgttggaattctccgcccggaaggtgggcccgaaggtgtacacgtcgccgaaagccatggcgaagttctcggcgttgagctggccggagacggtcagattggcgggcttgccgaagaagtcctggctgtagtccaccttgccgtcctcggtgcggggcgggttctccatgtccagggtggtcacccggaacatctcgccggcgccctcgcagtcggaggcggtgatgatgggggtgtggacatagacgaagccccgatcctggaagaagcagtggatggcgtgggccgccacgctccgcacccggaaggcggcggagaacaggttggtgcggggccgcaggtgggcgatggtgcgcaggtactccacgctgtggcgctttttctggagggggtactcgggggcggaggggccctccactgccacggaggcggccttcacctccaggggctgcttggcctccggggtgagtaccacagtgccggtgacggacagggccgcgcccacgttctgtccggcgatctccctgtagttgtccagggcgccggcgtccaggacgatctgcaggttcttgaagcaggagccgtcgttgagctccacgaagccgaaggtcttcatatcccggatggtgcgggcccagccggacaccagcacctctttcccgccgaactgctcctggtcggcaaagatctgtgcaatttttatgcgttccattggtcgctccctctattcttaaaaataaagtatcaatgggtagtagtataccatttttcaaccattttgcaagggctgagggaaaaaaggcaggactacctccgttcgggtccgccgaagataagcgcctcccgcgcctcgtcagacagggtacggtcgcggaacccgtagaggaggacccctagggcggccagggcggcggccagggcgtactccaggccgtccagcgcgccggggctgaacgggagaaggatgttgcccgccaggaaaaccgaggcggccacccccagcacagccgtcacccgcccgccgggcatgcgcaccgggcggcggaggtccggccgggcacgccgcaggcggagcaccgcggccagggacatgatccacatgacgatggtggccagggaagcgatattgatgaagggcagaaagaagagcctgcccgtgaagggggtgagcaccacgaaggcggcggtgaaccagatgcagcgggcgggggtgccgtatttcgggtggagggcggaaaacgccctcgacaccagtgcaaagcgggacaggccgtagagcatctgggcggaggagtagagggtggagttcatcacccccaccgcgcccacaaaggcggtggccaggaagagcacccgcacggcgggcacgccggtgatggacaccagcacgtcggcgaagggggcggtgcggcccaccgcctcccgccagggcatacacccggccacagcggtggacaccaagcagaggatgcccgtcaccaggaacaggcaggtgatgagggcggctcccgccttgcgggcggcggggccggaggcgtcggcggcagccttggacaccgtctcccacccggccacggagaacaccagcagggacaaaagggaggccgagccggcaaagtcgaagtccagccccccatcggaggcgtacaccgccgggtcgaagtgggtaaagcacaccgccagccccacggcacacatgatcagcagcaccaccgtggccagcttggccagggaggcgcacacgttggccccccggagctgcacccacaggatggcccccgccagggccagttggatggccacattgggcagggtgacggggaaatcccccagctcatagagcaccgccgtccgccccagggcggggaacagctcgtccagcagggagacggcggccagatccacccagcagaacacaatggtgttcatcaggatgcccgcccaccccacggcgaagcccccccggctgccgaaagcggcgtaggagtacaccacctcgccgccgggcagggggagcatggggatggcctccatgtaggcgaaggcaaacggcagttcaatgatgatgcacagggcgaaggccaccaccagattgagcggtccccccgccgtctccagccacgtgcccgtcagcagcagccagctcgtgcccagcatgcacccgattcccatggccaccaggccgaaatagctgatgcccttcccgccggactttcccattcagatccctcatttttcctcagatgaacctattatagcaccttccggccggttttcccagccccccggcccgactttcgcagagagactgcccacaccagccacgccagtgcgctccccagcagcggcgcggcacaccaccacaggagcaggaaccatcccatgaccatccagcccgccgcgctcaggaagagcacccctggcaccgccagaagcgccagaggcaccagaagccgccacaccgccctggcccgccggcacagcagcagctgaagaaaaaacatagggaacgcatggaagtacaggagcaggagctggtgccagggcggtatgttcagaggcagatcggaaaaggccgcggcaaaggccgcagtatagaccgccatggtgaccgcgaagcaccccagaagccattgatccgttcgtctcataagcacacatcctctctcttcaccgggagctgccggtgacggctccgcaggcccatagggcgggggcttgcccccgccgcttttcaaagggcgcccggcgcagctccaccccaggtgcgtccggaaaaggcatccggcccgttaacccgttccgcccctctcccggggatacgcccccgccgcgttgcccagcagggcggagatggatggcacgaggcagagcgcgggagtccgctttcctacgacgatcagcaggcacagggcgcacgccacggggaaaagggggcacagaccgtgccgttttcccagggacatccctatggcgaggcagccaaagggcaggagatagacccccgccagcaccgcggctaattccccggcgaggccgcccagcagggcgggcagaagggtgcaggccagcagacaccaggggagccagaggactgtagccctcagattgaggcgaaccgggccgggcgcaaagcgccagaccagggcggggatggccagaatcgccagccagcacgccagcgcaaccatcactcccccgcgcctcccctccgccgccgcagtgccgcgccggtcaggccgcccgccagggcggcgagaaaggcgatggggagcatgtcggtgtcggccacattggacaccagccttgccagcagggcgaagcaaaacaggaaccccgcgcacgccacgggatagagggggcagaagccctgccgcttccccagggacagggcggaacagaaggcgccgacgggcagcaggaggtaggggtagagcaggccggagagcaccggcacgtcgccggcgtcgcacagccgcagcacaaagggcagaagcagacacagcagggcggcgaaggggacatagggcagggtctcccgccagtggaacagggagggcccgggggccaggcccagccgctcccggatggcggacacctccgcgtaccagcccacccagcggcccagccacaccagcagatacaccagcgccaggggcaccaggaaggccgccgtctcacgcacaccgaagttgagccccacccacagccccacggtggccgccgtcagggcgaagtgggccagcgtccgccccaccagggcggagccgtccccggcgaagggcagggtggccacccccacctccgccccgaacagggcgtagagagcgaaggacagggcaatccccaccccctccagcccgcgggggaaaccgcagttcaggaacgccagcgcgagggcgctgggcgagcccgctatgagagaccccgccgcccaggccgccagcccgccgccggccatccccagcagagcccctgccagcgcccggcggagggccctcctcttgtcgtcgaacagcatgtcgttccctcctttttacagtcccaaagcctctttgatcttcctcacgtaccgccgggacacatagctcaccgcgccgccctccagcgtcacccggatggtgccggtaagggagagatccagggcggtgatcttccgcaggctgatgatctccgagtgggagatgcgcacgaaggtgtgccggtccagccggccctccagctcgtacagccgctccttcagatcgtacaccccgccgggggtctggcacttcacgcccttctcctcgccgtagcagcggagaatgtcctccgcggccaggggaacggcccggcccccctgccagccgacgaggacgccgcccccttccagccgggcggccagagccttcacctcgtcggtgagggcgggggcgttgatcacaaccgacatcccgtcgcagcccgggtcgatgcgcagctctaccttcatgcccttcccccctttcaaccccactatagcgaaaaaagggccgtctgtccaccgatttcggacagacggccccaatgggccgatattcggtttgctccccgccggggcgcgccacagagaccggatgctccgggttcagcggaacagggcgctcgccctgtcccctgcaggggcggccccttgtaaccgcccctacgcgatggcctcgacccccacctcataggtccaggtgccgtcggcattctgccgggcggtgcagtcggtaaagaaatacgcccccaggccggaggcccacttctgcgcctcaaagccctcctcggcggagccggacagggagaacaggcaaccgttttcccagcggtagagggccacgctgtcctcgtacccctccgccggctcggtcatgggggtgaggtagcccgcctcccagatctcctccagagtaccggtgatgggcatcaggccgtgggcgttcccaaacacccaggccagggcggatttctcactctcagccaggtcggtgaggccggagagatccacccccagctcctccagccctgtgttgagggcagtatctacctcccacaggtcggacagcacctggagatacagcccgcagcggtcatccgccggctcctccagcacggtcacgccggtcacatggccgaacttggcgggataggtctccagaatcattccgtcaaacccgacctccaccatcgccccgtcagccaggggcccatccaccgccagcccctctgtatccagggtatacacgtcccccgcgccccccgggccagccagcaccagctccccttcctccgccccatccacaatgcggcaagtcattttttcgggagcccccgcagtcaggccgggctcctccgagggggagcccgccggggttccccccgcgggggcggcctggtttccggtggatgcacacccggccagcaggagcacaagggcgaacagcagcaggctttttttcatggaacattcctcctttcccctcttggacggcgggacgtggaaaaagttcctgaaccggggagattcctcttgacagaggccctctataagcatatgattatatcaacagcttatgtttaggaggagaggccatgactcagcgggaacggcagattctcaagtggattgaggagaaccccctgatctcccagcaggagctggcggacaaagcgggcatcgcccgctcgtcggtggcggtacacatctccaatctgatgaagcagggccatatcgccggcaagggctacatcgtccgcaccgctccttatgtggtagtcgtggggggcgtcaacctggacatcggcgggcggccccacggggagctggtggcggcggactccaaccctggccaggtgcgcatgagcctggggggcgtggggcgcaacatcgcccacaacatggctctgatggggctggacgtgcggatgctcaccgccttcggcgacgatatgaacgcccagcgtatcgccgcctcctgcggcgagctgggcatcgacatcagccagtgcctcaccgtgcccggcggggccacctccacctatctgttcatcaccgacgggcacggggacatggccctggcggtcagcgacatggagatctatgagcatgtcacccccgcctttctggccgggcgggcccggctgctccaaaatgcccagctcctggtggtggacaccaacatcccggcccagtccatcgcctggctggcggagaatatccgcctgcccatcttcgccgacccggtgtccaccgccaaggcggagaagctgcgccccgtactggggaagctccacaccctcaagcccaaccggctggaggcggagctgctctcgggcgtgtccatcaccgacgcggcgagcctcaacgccgcggccgacgccctgctggccaccggcctgcggcgggtattcatcagtctggggggcgacggggtgttcgccgccgaccacagcgggcgggtacacgtgccctgctgtcccggagagatggtgaacaccaccggctgcggcgacgcgggcatggccgccatcgcctgggcctatctggagggcaccgggctggaggacaccgcccgggccgccatggccgccggggccatcgccatggagagcgccgagacgatcaaccccgacatgagcgcccggctgctccgccggagggcgggcttcggggagggagtggagacgccttgaccttctggaccgcgcaaatcctggggctgatcggctccctgctcgccttcaccgccgtccagaccggcagccgccggaagatcatcggccttcagcttgtgtgctgcgtgctctgggtcgtccagtacgtgctgctgggggcgtggacgggggtgctcatcaacctgctgggcctggcccgcggcgtggtgtgcgcctacaacgaccggccctgggcccgcagccgcctttggctggccctctttctggcctgctatggggcggcccccctcctcacctgggacggcccctactgccttctgctgggcgcggccatgatgctcaccaccgccgccctctggacgcggaacatgcgcctgacccggctgctgtttctcctcaactcccctccggtgttcgcctacaacctgatcgccggctcctataccggcgccgccatcgaggtggccgccttctgctccttcgcgctggccgtgtggcgctttgatctccgccgcccggccgccggcccttcctctccggcctgatcactccgcaatccgtattttataaatatattttacaggaggtaatcaccatgaatctcaatccgtatctggacgtcgcccctgaagtagccgccgctgtggccgcgggcaagcctgtagtcgccctggagtccaccatcatctcccacggcatgccctacccccagaacgtggagaccgccctcaaggtggagcagatcatccgggacagcggcgcggtgcccgccaccatcgccattctgggcggccgcctgaaggccggcctcaccgccgaggagatcgagtatctgggcaagaagggccaggacgtgaccaaggccagccgccgggatctggcggtgctggtctcccgcaaggccgacggcgccaccaccgtcaccaccaccatgatgatcgcccacatggcaggcatccaggtgttcgccaccggcggcatcggcggcgtgcaccgcggcgccgagaccaccatggacatctccgccgatctggaggagctggcctccacccccgtgatggtggtgtgcgccggggccaagtccatcctggatctgggcctgaccctggagtacctggagacccacggcgtgcccgtcctcggctacggcaccaaggagctgcccgccttctacacccgcaaaagcggcttcgaggtggactaccgggtggatacccccgcggagctcgccgcggccttccgggcctccctggatctgggcctcaggggcggcatgctggtgaccaaccccatccccgaggagttcgccatggaccacgaggtgatcaacagggccatcgacgaggccgtcgcccaggccaacgcccagggcatccacggcaaggccaccacccccttcctgctggccaaggtgaaggagctcaccggcggcgacagcctggactccaacatccaactggtgttcaacaatgcccggctggccgcccagaccgccgccgagctgtgcaggctgggctaagttcccaattccccaggtcccctgtgcgtcccaaacgcacaggggaccttttttcggttttggcggcggaatatttctttttcttaacattcgcccccaatccgttgcatcccgtccggccgggacgtataatggctgggaacggaacaaagtttctccttgtatggagcgaaaagaggcgattttgaatggcgcggatgcggcattttctcaaacggtgcccggcggttctgctgagcgcggccctgctggccgctgctgtcggcactgccgcggcggcggacactcccgcccccaccctgggcatctacaccaccggggacatgggggggcggctctaccgtgaggaccccgtgaccggggaggcagtggagtacagctatcagaatgtggcctccgccatggaggcggagcgggcctcggtggacgccgccctgctgctggacagcggtgacgcggtggacaacgggctggtccaggacggcggcgcggcggaggccctggccctgcgggccatcggctatgacgccctggtgcccgctgtgggtgaattccgcttgggcccggaggcccgggacgatttcttcgccgccctgggtgaagcgtcggaggacggcgccccggtgcgcgtcctctcgggcaactacctggacgaggacacccaaagcccggaggaggatgcctacgaggtctttactgtggagctgggccggcgcgcggtgcgcatcggcgtgctgggcctgggcgccatggaggcgccggaggagctccccgagtcctttgtctccggcgtgcgctttgcccaccgggacaacacctccggcagctatagttgggagtggaccggctactggcaggagcggctggaaaaggagaactgcgacctggtggtggtggtctgccacgccggacaggacgaactggcccgctttgctgcggagaccaccggcatcgacctgctggtgggcggccacggcgaggcggcggcggaggccctccagaacgccgacggggagccggtctccctggtcagcggcggcggcacgtccctgacccgcaccacaattaccctctcccccaagggggaggccgtggtgggtgagagcaccctgctccccctgtccgactatgagccggacgaccgcctgaacaaggccctatccgccgcccaaagcgcagcgtctgaccgcatgcaggctgccgtcggcaccctgtccggcgactggtcagaggagggctctcccctgtatgtgcagagcgccacggtggatctggtggccgaggccatgctgtgggccgccgatgccgacgcggcccttctctctcccgccgccctgggcggcgcttccgccgcttcccggttctccggggaggatgacactgcggcgctctccctgcgggactgcgccgcgctggcccccggggacagccccgtcgtcctggtggagctcaccggcaccgagctgcgccagtggctggaccgcagcgcggaggcctatcaggcggagccggacggctccatctccggcggagagggtgccgatgtgctctatggtatggactacaccctctatctgggggcttctgagggacagcgggtggacggcctcgcctttaagggcgctctggtggacgacggacagaccttccgcgtagccgtgtccgccgaccgcctgtccgcccccgacttcccggactgcacccccctctggtccgccgcccgtgacagccgctttgccgcccagagcggcatccccgccgcagtcctggccgggtatctctccgagcagacccacctgctgggcatgctctccccccagcggagcagcacatggagcctctacaccggctccgtcaacggcccgctgaaccgcctggagtttgtcaccatgctctatgagatggccggaaagcccaagcccggagccagcgccgcctttatcgacgtgtccaacagcgacgcggcggtgtgggccgccgagactggcgtggtcagcggcaacgggacaggcaaatttctccccacccagactgtcacccgggagcaggctgccgtcatgctctacaattacgccaaattcctggggctgaagaccccgtcctccggcccctccgccaccgcgctgctggactgcggcgaaatcgcggtctgggcccgcccagcggtggagttctgtatccggacgggggccctccccgccgccggactgcggggggacctcttcctcccccggggcaccctcacccgcggagaggctaaccgctgtctggccgccttcgcggactacatcgaagccaactgaacccaataacagcagccccggcggacaaatccgccggggctgttcagcctgtcaaaagagtcttttcgacaggctgctggacattttgaaactccgaaaaagtttcaaaatgtcgtttgatccgacgcgaaagggaaccctgacggttccctttcacactatccctccctccgaacgctttagaaggagggttaatgggcagcctgagcagctcccgcggacgaatccgccggggctgctttctatcctctcctactgcgatgtatctgcctctatggagcgttcgagggccgcaatccggtcattcaatgcctctatgtccggcgcctccaccggcgcgttgctcaggccgtagacggccttgagggagaggacgcggtacacgctctcgtccagccgctccatggagatgcggccgctttccaccgcctccaccagggcggcgtgggccgcggccaggttgtccgcgccgtggcacaccaacagcaggtcacatccggcctccacggccagtacggcggcctcccccataccgtaggtgttggaaatggcccccatggtcaggtcgtcggtgcataccacgccctcatagcccatctcctcccggagcagccccgtcaccacctcgggagacagggaggccgggttgtccgggtcgatctgactcaggaggatgtgggccaccatgatggcaggaatggaggtgtcccccccataggtaccgtagacgcaggtagtgtcgatggcctgtcggaagggccgcagctccagctcctccagttcctccaggctcttgtccacaacaggcaggccgtagtgggagtccaccgccgtgtccccatggccagggaagtgcttggccaccgggatgacgcccccagacaggatgcccagggcggtctcattggctgctccggtgacggttgcggcatctgtcccaaaggcccggtcgccgatcaccgtattctccgggttggaccagatgtccaggctgggggcgaagtccatgttgaagccgaaggcagcgcactgggccgccagggtctggcccagcgtaaagcaggcatccatccgagcctcggggtcggcaatggaaccaaagtccagggcggagggcagatcggtcacctccggcggcatccggtccacccggcccccctcctgatccacgcagaggaacaggggggtgtagtccccgttgagctccttcagcccgttggtgagcgccgccagctgctccgcgctctccacgttgcggccaaagagaatcacgccgcccacctgatagccctggacggcctgcaccgcgtcctcccccggctctgtgccctcgatccccgccaccaggagctgggccgccttctgctccaccgtcatccccgccagggcctcccccaccggatcgggggtgggggtgggggacggctctggcgtgtgggtgggcaaaatggtgggcgcgggggcggtgggctgagtcggttctcccccctgtttttgacatccggcaggcagagcgaatacaattagtaataaaatagccaatagcatccgttttgtcatcgttttttcctccctttccgccccttgggcacatgcatggcccgcctgtctttcccccggcgcgggggcatctcctcccggcgctccgccggacgggtgggacgcggggcaagctggccgccaggcagtacaaaatcgatctgcccggtggcgggatcggcggcggcgcacaccacctccaggggcacaccgaaggtgtaggccgtcccgcccccctcctccgtcagcgtgaggcgggtctcgtcgtagtggtagccccggccgggcaaggcctccacccccagcaggccctccaccccgccgggcagcaggacaaacaggccgaagcgggtgacgccggacacggtgccggcaaaggtctcccctacatggcccgccatgaattcggccatgtagcgcttctcaatctcccgctcggcgctctgggcggccagctcccgctgggaggactgcaccgccgccttctggaccgcggcggccagtcttctctccaccccgccggacagcctcccgtccagcagggcggtgaggatgcggtggaccatcagatcgggatagcggcggatgggggaggtgaagtggcagtagtatttggccgccaggccgaagtgccccaggttttccccgtcgtaccgggccttcatcagggagcggagcaccatcatggacaccgccgcctcctctggcttccccttcgccgtgtccagcagcttctggagggaggggccgtcggcctccttcaaatcgtagcccaggggggccagcatggcccgcagcgtctccgccttgtccgtggagggcttctcgtgaacccggtagacgcagggcttgtccagccggttcagatgctcggccacgcactcgttggccgccagcatgaaggactcgatgagcccctcgctgatccccggcgtgcggagcaccacgtccaccggcgtgccgctctcgtcgcacaccacatagctctcccgggtgtccagctccagggcgccccgccgcctgcggcggccctccagcacccgggacagcgcggccatgtcctccagcatggggagtatccgggcgtaccgctctgccagggcggggtcgctgtgggccagcagcgcgttgcagtcctcataggtcatccgctccgtggtgcggatgacgctcttggcgatggtgtggtccaccacctccccctccggggtcagggtcatgacgcaggacagggccagccggtccacccgggggttgagggagcaaatgccattggacagctcccggggcagcatgggcaccacctggtcggcaaagtacaccgaggtcccccgctcccaggcctccagatccagggcggagccggggcgcacgtagtggctcacgtcggcgatgtgtacccccagcacccagcggcccaggccgtcccgctccaggctcaccgcgtcgtccagatccttggaggaggccccgtcaatggtgatcaccaccttgtcccgcaggtccagccgcccggcgacggcgctctcctccaccgactggggggtggccttggcctcgagcatcacggcgtcggggaattcccggtcgatctcgtactggtacaggagggcggccacggcgctctcccggtccccggcggggccgaacacctcccgcatggtacccatgggcgggtgcttggcgcttccgaagctggtcatggccacggcggcccgatccccggcccgcacccccttccgcttggtgagcacctggatggggccgggcagccggtcactgtccggccggagccacagcccccggttgtgccggaccagcacgccggtgaccgtcttattggcccgctccaccacggcagtaatccgggcggtgcgccgccggccctcctcccctccctcgtcctccggccgggccagcacccggtcgccgtgccacgcgccgccctccgcccggggcggaatgaaccagtcgtcctcccgccccccgccgtcctccggtaccagaaagccgaagccacggctggtggcctgatagattccggcgagcccgccggcctgcttgtcctgtttcatatcatcgttccctttcttccgcactccggtcctccggccgggatgctccgggtgccgccgcccacaggcgcggcgtctgctgctattgtaccataattttgtctcatccggcatcgaaagatacaaaaaccgccctcccgaacgggagggcggtttttttgcttcttagagcaggcacatgacaaaggtaattaccacaaagccgatggccacccatttggtcagcttggccagcttggcgtcccaggtcttggcccggttcttggccataaaggtatccgccacgccggcgatggcgccggacaggcccgcgctctttccggactggagcagtaccacggcgatcaggaaaatcgcggccgccacgtccacaatgctcagaatcaactgggggatattcacgctgcatcgtcctttcggccccggatggggcatcattcgtccatacgctatggtctatgggcgcagttatcccgcgccgctttcaaacgtggattctatcgtagcacatttccccgccgatttcaagcattttttcgcatttctcagccgctccgcacgatccggcggctgccccagcaggtggccaggaaatagccgccgtagatgaccagcagcagaaccgcggccacggcgctggaggccgccgcgtccaccttcccgacctcggcgatcaccgcgttggccgccgtcatgcccacggcggcgtggaccagcgccagggccaggggcaggaaaaaggagaggaatacctggatatccaccgaccgggcccgcatccgctccggcgcgcccagccgggccaggagctggtagcggggggcgttgtccgccgcctgggtgagctgctgaagggccagcaccgccgccgaggccagcaggaacaccacccccaggtacaggccgatgaagagcaccagcaccttggtgcccataacctccatccaggtcccgatacgggtggtgcagccgtagacgcccagggtgtccagggtagacagcgcctcctgaaaccgcgcctccgcagcatatttgtccccggcatagtcggccaggaaataccagccgtcgatgtgagctccctgggccgcgccgtccggctgaacgtccaggccgtggtgcgcccggaaggcgtatgccgcgtcctggccccagcggcccgcgatggcgtcgtgcatggattgggtgatggcccgttcttccccggtgcgatacaccggaacggccagcgagaaggcgcactctgcctccggatcgaagcctccctccgccagcagggcggggaggtccacctctccctcctgctccgggtagaagagcagctccacgtcctggggggcctgctcggccgtcatctgctccaccgtgttgttgagccctaccgagctggcggtgatgccaatggccagcaggagcatgaggcagatcaccgtcatggagcggtaggtggtgttgatgcgggcgttgaactgccgcaggacaaacatgttgaggttcctgtagtagagccgcttgctgctctggcatacccgcagaaggaacccggacagggagcgaaagaagagcagggtgcccaggctgcccaggccgatcatcacccagaacagcgcgtccacccgcagcaggccccgggtgaggagcatggcgtaggcgacggccagcagtcccgcccccgccagaaagagaaccaccgacacccccaggctctgggccttgagctcctggttcacccgccgggcctgcatcaggtccaggagcctgcaccgggagacggcaaaggcgtggcagagcattaccagcaggaagataagggagaaggccagggccgttttccccatggccaccagggagacagagaaagtgaactccgtcatgggcacggcgaagagcccggcggtgaaggcggacaggccccaggccgccagcacccccagccccaggcctgccagcagggccagcacccccatgcacagggtttccagcaggagcaggcgggccacctgcccccgctccatgcccagcagcaggtaggtgcccagctctcccttccggcggcgaatcaggaagccggaggcatagaggatcagaaaggccagcaccacccacacaaagacggagagcatgccgatgagctcccggatggcctgggccgtgggagcctggggaccgctgcccaggtattggaacaccgcctgggtttccagggagttgaacacatagaacaggcacacgccgaaggcgatggtgagaaaccacactccgtagtccttcatgctgcgccccacatttttgaaggccagcttagagaacatcgctctgatcacctcccaggcgggtcaccacgccgatgatctgctggaaaaacgcccggcggctctgcccgccccgctcaagctgggtgagcaccgcaccgtcctgcaaaaagagaatgcggcggcagtagcttgcggtgaaggcgtcgtgggtcaccattaggatggtggcccggccttcccggttgagggcctcaaaccggtccagcagcagcttggcggagcgggagtccagggcgccggtgggctcgtcggccagcaccagagcggggtctgtgatgatggcccgggccgccgccgtccgctggcgctgtccgccggacatctggtaggggtatttgttcaggcagtcggtgatgccgagcagctccgccgtctccttgacccgcccctcgatctcccccgccggagtcccccggatggtaagggccagagcaatgttctcgaaggcggtgagggtgtccagcaggttgcagtcctgaaacacgaagcccagccgctcccgccggaaccgggagagggagcggcccttcagcgccgtcacatcctgcccctccacccggatatgccctgctgtgggggtatcaattgtggcgatgcagttgagcagggtgctctttccgcttcccgaggcacccatgatccccacaaactccccccgctccacggaaaagcttacgtcgtccaccgcgtgggtgacgcttccccgtccgccgtagtcccggcgcagatgctccacactcagaattggctccatgttcagacctcctttgattctgagaaaagcttatcaaagggatcttaaaaaaaactaaatcccgccttacacttttgtgaagcgactctgacggttttctttccaaaattttgttcagtggcccttgatttattttttccctcctctataataggaagaggatcattttaaactgataggaggactctttcatgcttattgtcgacaccaagaacgcccccggcgccatcggcccctactcccaggcctacgagaccaacggccttgtcatcacctccggccagcttccggtaaatcctgccgacggcaccatgcccgagggcatcgccgcccaggccgagtggagctgtaagaacgtgggcgccattctggaggccgccggttccggcttcgacaaggtggtcaagaccacctgcttcctggccgatatcgccgacttcgccgccttcaacgaggtgtacgccaagtacttcacctccaagcccgcccgctcctgcgtggcggtgaaggatctgcccaagggcgccctgtgcgagattgaggccattgctgtcaagtaagccccgccctgcatcgaagacggatttcccaggcgcttttgcgcctgggaaatccgttctttttttacctgtccgcagcggctgctttaagcatctttcacaaaaaacagtctggtttttttccattccgccaaagaaattccacttgcatccagccagcaaatgggatatagtttgactgtactaaaaatacatttgtacttcaaaaaatttttgtgaggcgattggaatgagtcaccccgacaccaccagcaaggatgccgttttccaatggcgcggcatcccgcagcccggacagcttctcccgttgggactccagcacgtggtcgccgccgtagtcggcgtcattaccccggccatcctggttgcggacacctgcggtctgagcagcgcggacaagaccctgatgatccaggtctctctgatcctgaccgccctggccaccctgctccagctctttcccatcttccaccgcatcggctccggcctgcccgtcatcatgggcatcagcttcgcctacatccccacgctccaggccatcggcggcgaattcggcctgcccaccatactgggcgcggagatcgtgggaggcatcgttgccatcgtcttcggggtgctggtcaagtggatccgccccctgttccctcccctggtcaccggcacggtgatcttcaccatcggcctgtccctctatcccaccgctgtaaagtacatggccggcggtgcaggctcagagtggttcggcagcgccaagagctgggcggtggcccttatcaccctggctgtggtggtcttcctcaaccacttcaccaagggcatcaccaagctggcctccatcctcattggcatactggcaggctatgtcattgcctatttcctgggcatcgtggatctgtccggggtgggcagcgcggcctgggtcgccctgcccaggcccatgccctttgacatccagttcgtccctgccgcctgtgtgtccctgggcatcgtctacgtggtcaatgcggtacagaccatcggcgacctctcctccaccaccatgggcggcatggaccgcatgcccaccgacaaggagctctccggcggcatcgtgggccagggcgtcatgagcattctgggcgccttcttcggcggcctgcccgccgccacctacagccagaacgtgggcatcgtcaccgtcaaccgggtcatcaaccgggcggtcttcgccctggcggccctcattctgctggtggccgggctggtacccaagttcgcctccctgctgaccaccatcccccagtgcgtcattggcggcgccaccatctcggtgttcgccaccatcaccatgaccggcatccgtatgatcaccgaggggggcttcaccccccgcaagagctccgtggtgggcctgtcggtggccctgggcgtggggatcacccaggtgtccggctgcctggccggcgagggcttccccgcctgggtcaacaccgtgttcggctcctcctccgtggtggtggccgccctcatggccatcctgctcaacctgatcctgcccaaggagccctccgcgaacggctgattgacaaacgcgcccggcttccagaggaagccgggcacggaatttattccttcgactcgtcgatgtagctgtagagggtgtacttggagatgccgaagtacttgcacaccttgtcgccgctcttggtgatgagaaaggcccctgtctcgttgagaaactggatcgccttcaccttgtcctccttgtgcatcagcgccaccggcttgcccaccagcttgacgctctgctcgatgagctcgtccagcaggtcggacacgttgcgggagatggcctccggctcccgggactccttctccgtagcggtaaactggcggagcatgttctccatggccagcatgagggtgatgtcgtagttgatgccgaagatgccgatgggggtcccgtcgtcgttgcggatgtagatggtggtggacttgagaatctttccgtccttcgtcttggtcaggtagcacaggtggtcctgaagcttctcccggtcgccccgcagggtctccagcaccacgtgtgaagggccgtcccccaccttgcggccggtgacctggccgttctcaatggccacgatggagctctccgggtcgttggaatccaggtcgtgcaccaccacctcgcagttggggccgaactggctggcaatccctttggcaagctgaaataaaaattgcagcgtggacgcttctggcatactgttttctctcctttgccggcgcttttgttgatattataccacttccaggtattttttcaacaaaaattataaagcctaaaaattttttagtttttccaacaaaccctcttgcatcttgggcgcttttgtgctaaaattcaaatgtaagaccaattaaactgtatatactatacaaacaatttgaagattggttgtggctgcaacggagtgctctcgcgcacgggctgaatggacatgggattcggtttcggtgctggcgcaccgccgtcacagagtcgagtgtccattcatagggaatgggcacttttttgttggttgaaatccaaaggaggaatgacgcatgctgctggttggaaacggaagactgattacccgggacgaggccttcccctatgcggaggacggcgcggtggcgctggacggcgaagtcatcaaggaggtgggggccctgtctgagctgagggccaaataccccgacgccgagtttgtggacgcccgggggggtgtcatcatgcccggcctcatcaacgtccacacccacatctattcgggcctggcccggggcctgtccatcgacgggttcaaccccaccaactttctggaggtgctggacggccagtggtggtacatcgaccggcatctgaccctggacggcacccgggcctgcgcctacgccacggtgctggactgcatccgggacggcgtgaccaccatcttcgaccaccacgcctccttctgcgaaatccccggctcccttttcgccatcaaggacgtgtgtcaggagctgggcatccgggccaacctctgctatgaggtcagcgagcgggacggcgcggagaagtgcggccaggccatccgggagaacgccgacttcgcccggtgggcgaaggagcaggacgacgacatgatcaaggccatgttcggcggccacgccctgtttaccatctccgacaagaccttcgagcagatggtgaaggccaacgacggcatgaccggcttccacatccatgtggccgagggcatgaacgacgtgtacgactccctccggaactacggctgccgcccggtgaaccgcctgctctacaacggcgtgctgggggagaagaccatgctgggccactgcatccacatctcccccgccgagatggacatactcagggagacgggcaccatggtgtgccacaacccggagtccaacatgggcaacgcggtgggctgctcgccggtgctccagctcttccagaggggcatcctcatcggcctgggcaccgacgcctacacccacgacatgctggagagcctgaaggtgctcctgcccatgcagcggcacaacgcctgcctgcccaacgtgggctggcgggaggccaccgggatgctctttgaaaacaacgccaaaatctgcgcccggtacttcaaaaagcccctgggcgtgctcaagcccggcgcggccgccgacgtgatcatcatggattacaagcccttcacccccttctcccacgagaacgtggacgggcacatgctcttcggcatggaaggcaagaactgccgcaccaccatcatcaacggcaaggtgctctacagggatcgggagttcgtgggcattgacgaggacaaaatcaatgctttttgcatggagcagtccaagaagctgtggggcgaactcaaccacagaacttattaacagtcccgcattgattttgtcctcaccaagcgttttgccaccggcaaaaccttgatgtccggggcgattcactcgccccgggcagatcaaatcgctcggggcccccgcacggccccgccgggcgggcaaaatcaatgccttctgcatggagcagtccaagaagctgtggggcgagctcaaccaccgcaccgattgacgggagcgcgggcggccacaagggccgcccctaccgtaagcgccggacgtaggggcggcccttgtggccgcccgccagtctgaacacatctgaatcatatttgggaggccatccgttatgagcgatattatgagacccatgccctttgcccacctgatgaactggattttgagcgagtaccgcgcccagggctccgtgttcggcgtgtccaagctggtgcgccacgccgacgggaagtccctgcccatctttgaggagaagatcgagtccccctacggccccgccgccggcccccacacccagctggcccagaacatcatcgcggcctacgccgcgggcagccgcttctttgaggtcaagaccgtgcaggtgatggacggcgaggagctgtccaagtgcgtcagcaaaccctgcatcaccgccgcggatgagtgctacaactgcgagtggtccaccgagctctacgtcccccaagccttcgccgaatacgtcaaggcgtggttcgcctgcaagctgctggcgaaggagctggagctgggcgatcccgacggctttgtgttcaacatgagcgtgggctacgatctcaagggcatccagagtcccaaggtggacgcctacatcgaggggatgaaggacgcctccggcaccgaggtgtggcgggagtgcatggactggaccctggccaatctggaccggtttgagaaggtggacgaggcctatgtccggggcattaccccccacgtgtccaactccatcaccgagtccaccctccacggctgcccccccgacgagatcgagcgcatcgccacctacctcatcaccgaaaagaacctaaatacctacgtcaagtgcaaccccaccctgctgggctatgagttcgcccgcaagaccctggacggcctgggctacgactacatccagtttgacgaccaccacttccgcgaggatctccagtgggaggacgcggtgcccatgttccaccggctgatgcagcgcaccggcgagcggggcctggagttcggcgtgaagatcaccaacaccttccccgtggacgtggccgccggcgagctgcccagcgaggagatgtacatgtccggccgctccctctaccccctgtccctgtccctggcggcccgtctggccaaggagttcaagggcaagctgcgcatctcctattccggcggcgcggacattcactcggtgcgggccctctttgacgcgggcatctggcccatcaccatggccaccaccgtcctcaagcccggcggctaccagcggttcagccagatcggccaggccctggcggacatctcctatgagccctgggagggggtggacgcggccggggcggccgccctggcggagatgccctccgccgacggccactatcaaaagcccatgaagcccatccccagccgcaagctggacaaaaaggtgccccttatcgactgcttctccgccccctgccgctccggctgccccatcgagcaggacatccccgcctatctgatgaaggtgggcgagggcaagtacgaggaggcgctgcgcatcatcacccagcgcaacgccctgcccttcatcaccggcaccatctgctcccaccgctgccaggacaagtgcatgcgtaacgcctacgacgagagcgtctacatccgcgcccagaagctgaaggccgccgagggcgggtttgaggccctgctgcccaagctgcaccccgccgcccccgccgcgggccggagggtggccgtggtgggcggcggccccggcggcatgtccgccgcctacttcctgggccgctccggcgtggacgtcaccgtcttcgagcgccgggacgccctgggcggcatcgtgcgccacgtgatccccgcgttccgcatccatgacgaggccatcgacaacgacgtgcgcctcatggaggccatgggggtaaaggtggagctcaacaccgaggtgaaggatgtacaggagctcttcgcccagggcttcacccatgtgatcctggccaccggcgcgtggcagaagggcagcgccgggctggagtacggcgaggagcacaacgtcatcgagttcctggaggccgccaagaaggcccccgataccctgaacctgggccggcatgtggtggtcatcggcggcggcaacaccgccatggacgccgcccgggccgccaagcgcctccccggcgtggagaccgtctccctggtgtaccgcagaacccgccgctatatgcccgccgaccaggaggagctggagctggccctggccgacggcgtggagttccgggagctgctcgcccccgtgggcgtccgggacggcgtgctcacctgcagggtgatggagcttggcgcccccgacgccaccggccgccgctcccccgtggacaccggccggacggcggaggtgcccgccgacacggtgatcaccgccgtgggcgagaaggtggacacggagctttacaccgccaacggcctttctgtggatcaacggggccgcgccgtggtcaacccggataccctggagtcctccgtcaagcacgtctttgtggtgggcgacggccagaagggccccggcaccgtggtggaggccatcgccggcgccgcccgggcggcccaggccatccaccccttcgacgcggacgcctgggtggagcagaacgtgaaccccgactatcagaagcccctggccaagcggggcgacgtgtgcaccgactgcgcctcctgtgaggacagccgctgcctgggctgcgccaccgtgtgcgagacctgcaccgaggtgtgccccaaccgggccaatgtggcggtgtgggtgcccggcatgcgccagcgccagatcatccacgtggacggcatgtgcaacgagtgcggcaactgcgccaccttctgcccctatgacagccgcccctatcaggacaagttcaccctgttctggagcgcggacgacttcgagaacagccggaacgagggcttcctccgcctggaggacgtcagaacccgggtgcgcctgggcggccaggtggccgactacgacgtgtccgacgccgcctgcggcctgtacgaccccctgcgccgcctgatctgcgcggtatacgaaaactacgcctatctgctgggataatccggcggcggtgagcctcagcctttcgctggggctttccgcgcgcccatggaatctgaatcaggaaatgaggaacctgccatgagtgagtgttattcctttgtggtcaacggcgtcccctgctccacggaggaggagaagcctctgctgcgctacctgcgggacgagctgcgcctgacctcggtgaaggacgggtgcagcgagggtgcctgcggcacctgcaccatcctggtggacggcaaggccgtcaaggcctgcgtcctgtccaccaagcgggccgcaggcaaggagatcgtgacggtggagggcctctcggaggccgagcgggaggccttcgtctacgccttcggcgcggtgggcgcggttcagtgcggcttctgcatccccggcatggtaatggcgggcaaggccctgctggatcagaaccccaaccccaccgaggcggagatcaaaaaggccatccggggcaacgtgtgccgctgcaccggctacaagaaaatcatcgagggcattgccctggccggggccatcctccgcggggaggcgtccgtcgatcccgccctggaggagggggaggactacggcgtgggggcgcgggccttccgcaccgacgtgcgcgacaaggtgctgggccggggggagtactgcgacgatctgtacctggacggcatggcgcacgcctccgccgtccgctcccagtacccccgggccagggtgctggacatcgacgcctccgccgccctggccctgcccggggtgctggccgtcctcaccgccgacgacgtgccccacaacaaggtgggccatctccagcaggactgggacgtgatgatcgccaagggggacatcacccgctgtgtgggggacgccgtctgcctggtggtggcggagaatgaggccgtgctcaagcaggccaaggagctggtgaaggtggactatgagcccctggagccggtgcgcaccatccaggaggccagggcggcggacgcccccagcctccaccccaacggcaacctgtgccagcagcgccacgtcacccggggcgacgccagggccgccctggcccagtccaagtatgtcgtcacccagtcctaccgcacccccttcaccgagcacgcctttctggagccggagtgcgccgtggccttcccctacaaggacggggtgaaggtctatacctccgaccagggggtgtacgacacccgcaaggagatctccatcatgctggggtgggagcccgagcgcatcgtggtggagaacaagctggtggggggcggcttcggcggcaaggaggatgtgtcggtgcagcacctggcggtgctggccgccctccgggtgaaccggcccgtgaaggcaaagctcacccggcaggagtccatcaacttccaccccaagcgccactatatggagggcaccttcaccctgggctgcgacgagaacggcatcttcaccggcctggactgcgagatccacttcgacactggggcctacgcctccctgtgcgggccggtgctggagcgggcctgcacccactcggtgggcccctactgctaccagaacaccgacatccgcggcttcggctggtacaccaacaacccccccgccggggccttccggggcttcggcgtgtgccagagcgagttcgccctggagtccaacatcaacctgctggcggaaaaagtgggcatctccccctgggagatccgcttccgcaacgccatcgagccggggaaggccctccccaacggccagattgccgactgctccaccgccctcaaggaaaccctgctggcggtgaaggacgtatatgaacagaacgcggctcacgccggcatcgcctgcgccatgaagaactccggcgtgggcgtgggcctgcccgacaagggccggtgcaagctggcggtgcgcaatggggtggtggagctctactccgccgcctccgacatcggccagggctgcgccaccgtgttccttcagatgctggccgaaaccaccggcctgcccctggaaaagctccgcaacatgggggccaactcggaggtggcccccgactcaggcaccacctccggttcccgccagaccctgatcacaggcgaggcggtgcgcatggccgccgccgagctcagggccgatctggacggggcgggcggggacttgtccgccctggaggggctggagtacagcgccgagtttttcgatcccaccgacaagctgggggccgacaagcccaatcccaagagccacgtggcctacggcttcgccacccatgtggtgattctggacggcgagggccgggtgaaggaggtctacgctgcccacgactcgggcaaggtggtcaaccccacctccatccaggggcagatcgaggggggcgtgctcatgggcctgggctacgccctcaccgaggacttccccctcaaggactgcgtgccccaggccaaattcggcaccctggggctgatgcgggccgaccagattcccgacatccacgccatttatgtggagaaggaggagctgctccccttcgcttacggggccaagggcatcggcgagatcgccactatccccaccgctccggcggtccagggggcctactacgcccgtgaccacatcctgcgcaccagcctgcccatgcaggacaccttctacaaaaagccagccaagaaggccgccccctgaccttccgcggggtcccggcggccgtccgtccggggtcccgctttcctgtttttcccttatgtttcaggcgcatttttatggatgctaaaaattttttagtattacaccattttttttagaatatcctcttgacatctgaacgggacgtggtatgatggtctcgtaaaacaaaaagtgagtgcaactttaaaataatttggaggcgaccgtcccaatgaaagaccagatcaaatgggtcctcaacaccatgcccaagagcgacgaccggcagctgcccatcatgtcgctctccaacgtggccaaggcccgctttttccacagcaccttcccccagtactccgtcacccccctggaccggctggacggcatggcccaatacctggggctggccggcctgtgcgtcaaaaacgagtccttccgctttggcctgaacgccttcaaggtgctgggcggctccttcgccatggccaagtacatcgccaaggaaatgggccgggacgtgtccgagatgacctacgactacctgaccagcgaggccttccgcaaggagttcggccaggccaccttcttcaccgccaccgacggcaaccacggccgcggcgtggcgtgggcggccaacaagctgggtcagaaggccgtggtacatatgcccaagggcagctccaagccccgttacgacaacattgccaaggagggcgccgccgtcaccattgaggaggtcaactacgacgactgcgtccgcatggccgccgccgaggccgcccagaccgagcacggcgtgatcgtccaggataccgcctgggagggctatgaggagatcccctcctggatcatgcagggctacggcaccatggccagcgaggccgccgagcagctccgccagctcggcgtcaaccgtccctcccacgtgtttgtgcaggcgggcgtgggctccctggccggcgcggtggtgggctacttcaccaacctgttccccaacgacccgcccaagttcatcatcatggaggcccaggcggccgactgcctctaccggggcgccctggccggcgacggcgccccccgcatcgtggacggcgacctccagaccatcatggccggcctggcctgcggcgagcccaacaccatctcctgggatatcctgcgcaaccacgccaccgcctttgtctcctgccccgactgggtgagcgcccggggcatgcggatgctgggcgtccccgtcaagggcgatccggtggtgatctccggcgagtccggcgcggtgggcatgggcctcatcgccgccatcatggagaccgatgaatacaaggagctccgggaggccatcggcctagaccgcttcagccaggtgctcatgttctccaccgagggcaacaccgaccccatgaagttccgcaaggtgctgtgggacggtgaatatcccacggtctgactgcgtcagaccgtggggccccaagcccctttccatgctcggcggaactgaattccgcctgcgccaaggttttgcccgcagggcaaaacgcttgtacgcgccactcggcgcggctccggttccggggcacatgtccccggaacgaacaaactgcgcgcctgcggcgcgcactctgtaaggcctttaagaaaatacaaccacctgtggatcaatgatggagggaaacgaacatggattacgagcagatcaagaaggcagccgagggctacaaggccgatatggcccgcttcctgcgggcgatgatctcccaccccagcgagagctgcgaggagaaggaagtggtggcctgcatcaaggccgagatggagaagctgggctacgacgcggtggaagtggacggcctgggcaacgtcatcggctggatgggtgagggcgacaagatcatcgccttcgactcccacatcgacaccgtgggcatcggcaacatcaacaactgggaggccgatccctaccagggctacgaggacgacgcggtgatcttcggccgcggcggctccgaccaggagggtggcatggctgccgccacctacggcgccaagatcatgaaggagctgggcctcattcccgccggctacaagatcatggtggtgggctccgtgcaggaggaggactgcgacggcatgtgctggcagtacatcgtcaacaagttcttccccgccaagggcatccgcaaggagcaggtggagttcgtggtgtccaccgagcccaccgacggcggcatctaccggggccaccggggccgcatggagatccgcgtggacgtgaagggcgtctcctgccacggctccgccccggagcggggcgacaacgccatctacaagatggccgacatcctccaggacgtgcgcgccctcaacgagaaccccgccgacgagaccgtggagatcaagggcctggtgaagatgctggaccccaagtacaaccccgagcactttgaggacgcccgcttcctgggccggggtacctgcaccacctcccagatcttctacacctcccccagccgctgcgccgtggccgactcctgctccatctccatcgaccgccgcatgaccgccggcgagacttgggactcctgcctccaggagatccgcgatctgcccagcgtgaagaagtacggcgacgacgtacaggtgtccatgtatatgtatgaccggccctcctggaccggcgaggtgtacgagaccgagtgctacttccccacctggatcaacaaggagaacgccgcccacgtccaggccctggtggacgcccaccacgccctctggggcgacaagcgcatcggccacgccgacgccgaggccaagcgggacgccatgcacctgcgggacggccgccccctcaccgacaagtggaccttctccaccaacggcgtggccatccagggccgctacggcatcccctgcgtgggcttcggccccggcgccgagagccaggctcacgcccccaacgagatcacctggaagatggatctggtcacctgcgctgccctgtacgccgccgtgcccggcaactacaaggaggagaacaagaccgccgacgtgtcccagttccgcgccggcaagaccaataataacattcagtaagaagcgcgcccgtaggggcggggcttgtccccgcccgcggacggccacaagggccgcccctatcccacaagaaaaaagaaaaggagattgccgctatggaaaaccttcagaactatattgacaaactcaacaagctcaacttcaaggagatgtacgagggcgacttcttcctgacctgggaaaagaccgacgacgagctcgaggccgtcttcaccatcgccgacgccctgcgctacatgcgcgagcacaacatctccaccaagattttcgagtccggcctgggtatctccctgttccgcgacaactccacccgcacccgcttctccttcgcctccgcctgcaacctgctgggcctggaggtgcaggatctggacgagggcaagagccagatcgcccacggcgagaccgtccgcgagaccgccaacatggtgtccttcatggccgacgtcatcggcatccgcgacgacatgtacatcggcaagggcaacgcctacatgcacgagttcatggacgccgtgacccagggccacaaggacggcgtgctggagcagaagcccaccctggtcaacctccagtgcgacatcgaccaccccacccaggccatggccgacatgctgcacatcatccaccacttcggcggcgtggagaacctgaagggcaagaagatcgccatgacctgggcctactcccccagctacggcaagcccctctccgtgccccagggcgtcatcggcctgatgagccgcttcggcatggacgtggttctggcccaccccgagggctacgaggtcatgcccgaggtggaggaggtcgccaggaccaacgcccagaagagcggcggcaccttcaccaagacccactccatggccgaggccttccagaacgccgacatcgtgtatcccaagagctgggcgcccttcgccgccatggagaagcgcaccaacctgtacgccgagggcgacagcgagggtatcaaggctctggagaaggagctgctggcccagaacgccacacacaaggactggtgctgcaccgaggagctgatgaagaccacccgcgacggcaaggccctgtacctgcactgcctgcccgccgacatcaacgacgtctcctgcgtggacggcgaggtggaagccagcgtgtttgaccgctaccgcgatcctctctacaaggaggcctccttcaagccctatatcatcgccgccatgatcttcctggccaaggtgaaggatccccaggccaccctgaaggccctggaggagcgcggcctggcccgctggttccagaagtaaaatctgcaaatttcccccgcccaggcgctccggcccgcccgcaaatacaggtactccggtattctgcgggcgggccccgtctttttcggcgcgggcacacaggcagggatgccccttgcggccgcccgcccctccgtattccgtaggggccgatgccctcatcggcccggcggcccgcggaacaggcagggtgcacacacaggtgcgcccctactgaattccgcctgcgccaaggttttgccctccgggcaaaacgcttgtacgcgcctcccggcgcgtaggcatttccgccccctctcctttcgacttttcttattttgaatgaggtgctattcatgggtaaacgtgtcgtcatcgccctgggcggaaaacgccccaggacggcacgccgccctgggggcccccttctgtttttacttgctcggcggaactgaattccgcctgcgccaaggttttgcccttcgggcaaaacgcttgtacgcgcctcccggcgcgtgggcatttccgcccctctccttttgacttttctttatcttgaatgaggtgctttttatgggtaaacgcgttgtcatcgccctgggcggaaatgccctgggcaacaatctgccggagcagatgatcgcggtgaagcagaccgccagggccatcgtggatctgatcgaggagggccacgaggtcatcatcgcccacggcaacggcccccaggtgggcatgattcagaaggccatggccgagctgacccgctcggagccggagaagtacatcccctgccccctctccgtctgtgtggccatgagccaggggtatatcggctatgatctccagaatgcgctgcgggaggaactgctggaccgcggcatctccaagggcgtggccaccgtgctgacccaggtggaagtaaaccgggacgacccggctttccagaaccccaccaagcccattggcgccttcatgaccaaggaggaggccgacaaaatggtggctgagcggggctataacgtcattgaggacgcgggccggggctaccgccgtgtggtggcctctcccaagccccagtccatcatcgagattgagtccatccgcgacatggtggacgccggactggtggtggtggcctgcggcggcggcggcatcccggtctataagaccgaaggccaccacctcaagggcgcggcggcggtcatcgacaaggacttcgcctcctgcgtgctggcccagcaggtcaacgccgataccctcatcatcctcaccgccgtggagaaggtggccattaacttcggcaagcccaaccagacctggctggacagtctgacccccgccgaggccaaggtctacatggaacggggccacttcgcccccggctccatgctgcccaaggtgcaggctgccgtggaattcgccgagagcgcccccggccgcaccgccctgatcacccttctggagaaggccaaggacggcgtggcgggccgcaccggcacggttatccaccagtaaagtgcaaaaaatggagttcccgcagggcgggaactccatttttaacgtccgaagatcagtacatagtagagcggaatggtgagaaacagcatccagcccgggtgccagttgtccagcaggaagccggtgatcaaaaaggccaccgtgaccaccacggcatagacctccgagatgccaagccagtaggtcaggttgggcagaatcaccatcagcgccagggtgagcagccacagcagcccctccttccacttggcccgcgcccgcttccgggccttctgctccgcctcctccgcggcgtcccaggcccgggcggcggcaaaaatctccgcgtcctcgtccgccggggcctcctccggctccggcgcggcctgggccgcctcccccgccggggtgtggagcagcagcgcgtccagggacacgccgtagagccgggccagggcgagcaggttgtccgtgtctggagaggactccgccctctcccacttggacaccgcctggcggctgacccccagcttgtaagccagctcctcctgggaatagccgtgctcccggcgcagggccagcaggcggtttgcaatctccagattcatgggcactcctcctcgccgttcagaatagcagagacgggcctgggccgccaccgcttccgggtttcatggccgcaactattggttgcccacctccagcagcaggtcgtacaccgcgccgtggacgtagtccagctcctcaaaggtggtaaacggccccacggagaagcgcaccgccccctggggaaaggtgcccagggtcttgtgggccagcggggcgcagtggaggccgcagcgggtctggatgccgtactcccgctccagccggaaggtcatctcggcgttgtcggcgcagagaaagtccacagacaccacccccacccggtttaccgggtcgtcagagcccagcacccgcaggccgtcctcctccagctccatcagccgggcccacaggtggcccgccagcttccgctcccgcgcccgcagggcctccccctcccggtccaggtagtccagggcagcccccaggccgaagatccccggcagattcagcgtgcccgcctccagccggtcgggcaggaaagagggcatgtccagcgactcggattggctgcccgtgccgccggcgaggaggggctccagctccgacgccagggcatcgctgaccaccacgccgccgatgccctggggccccagcaggcccttgtggcctggaaaagccaggccgtcgatgcccatggcccccatgtccaccggcaggacgcccagagtctgggccgcgtccaccaggaagaagatgccccgcgcccggcacagggcccccaccgcgccgatggggaaccgggtgcccgacacgttggaggcgtgggtgagcaccaccgcccggacgccgggcgtcagccgctctgccagattctccgtcaccagctccccccgctccgtgcagggcaggtactccacctccacccccgcccgctccagctggcggagggggcgcaggacggcgttgtgctccatgggggaggtcacgacccggtcgccgggccgcagcagtcccttgagcagcagattcagcccgtgggtggccccggaggtgaacgccacattgcgcggcccgggaccgttcaccagggtgcagagccgctcccgcacctccagcacccccccggccgcgtcataggcccgctggtagccgccccggccgatgttgcagcccacacgctcaatgtagtccgccatagccgcccccacccccggtgccttggggtaagaggtggccgcgttgtccagatatacggtgcgcatgtgtgactcctcctcaaaacaggcgggcggacaagctccgcccgcctgtatgtgctccgattctctcagatccgggtatccagcgccagttggaaccagtacgcgtcccgcggcatgcggggcagcagccgggacaggattccggcgctctctccgctgtcgtccagcagcatgcgggccgcgctgcgccgtccttccagagtgcgcagcagggcgttggcctgggtgctctggcttcggccgtcgggccggccgtccacgttggccgaccagcaggcccagccctcccgctccagcgcatccgccacgccggaggccgccccctccagatatacggtatgggtccgcacacggaccaactgctccaacaggccggccccctcctccaacgccgcccgcgccccatccaggctctggcccgggacggacaggcccaccgcgtggcccgagcccaccagccggcggagctgaccttccgccgccgccaaggcatccggcgtaaagaggaacagggcccggatgccgcgtgcctccagggtgtccaaaatgttgtccagcgccccgccgccggtgcactggaaggacaggtagaccggcagaccgtcctcctgctccggctcgtccgtgccgccgtccgatggcgagggggacgggctgggtgtgggctgggtgccctggttcagctcctggaggtatttatagtagcgggtgggcatggacagcccgctggccgaggtgacaaactgctgggtgtccagccgctcctgcccgtttgtgatacggatcagggtgccgtagttggtgggggtataggtgtaattcagtccaaagaagctgcacaccccggccagggggacaaacacccgcccgttgcgcagcgcggcacgcatgtccttcgcctctccggagaagccgtcggtgcaggtgcccgcgttcaggtcaaacacaagcatgccgttcaggctgtagagggtaaacttgtactcggtctccgtccgctcctgcccgtaggagactcccaggttcacccccgtcaccgtccagtcgaaggcggtgtagggcacatatatgtccccgttgatccaggcgggcatggcggacaggggcaggtccagcatctggtcgttctccgccatcagatagatggtgatctcatccgccttggccgtcccggccagcaggaggctcaggagcagcgccgccgcgcacaggccggacagatatttctggatgcggcgcatggcgcccctcccttcccggcaaaagccgttcctttcttgtcattccgccatgaagcccggcggaatggccgcatgacgccggatttcgcagtcccgccccaaggcgggagcaggcggaccgcgtcaggtataaccgccgctttgcggttattatatcatgaaaccccagccgggtaaagcggcagcttgcaccagcgggcccggcgtggtatgatgttgcccggaacccaatttaatgtgtttttaaggaaagatcaattccatccgccccgcggcttgggtatactgtaatcacaaaaccgttgaaagggtggcggcctctatgtcagtgactttggaacaggtggaacaactccgcgcgcacgcggcagtctcctatgaggaggcccggcgggccctggaggcctgtgacggcgatctgctggacgccctgatcctgctggagcgggagggccggattccgccgggcggcgggcggggcgctttttttaccacccagcccggtgccgccccggagccgccgccctccgggcccacccgggggccggaggcgtccgggaaggacgagaagcggttctgggggctggccgtgaccgcgggcggccaccgcggccgggaggagcgggggagctggcgcgcccgcctgcgggagctgctggcggcggcggtggatctgctgcgccactgcacggtcaaccagtttgaggtgtggcgcaacggggagcggatgaccgccctgcccgtgctgatcctgatcctgctggtgctggtggcctactggatctccctgcccttgctggtggtgggcctgttcttcggctgtaaataccgcttttccggcccggatctggacaaaaaccgggtgggcgaggtggtcaaccaggtgtccgccaaggtgggggacgcggtgggccaggtacgggacgaattcaagcgggaattcgacaaatccagggggaaaaaaggcaagtaaggagcgagagagatggcagagagaatcctgttggtggaggacgaggagaagctggcccgcatggtggagctggagctccaatacgaggggtacgaggtggagaaggccttcgacgggcgcgccgggctggaccgggccctgtcgggggagttcgacctggtgctgctggacatcatgctgcccgccctgtccggcatggaggtgctgcgccgcctgcggcgggagagcgccatgcccgtcatcatgctcactgcccgggacaccgtggtggataaggtgtccggcctggacatgggggcggacgactacattaccaagccctttgccatcgaggagctgctggcccgcatccgggcggccctgcgcaagcgccccgcccaggccgcggagccgccccggagcctgctcaccgccggtcccctcaccatggacaccgaccggcacgaggtgagcgtgaatggcgagggggtggagctcacccgccgggagttcgatctgctgcgctacctgctggagaacaaggagcgggtcatctcccgggagtccctgctggaccatgtgtggggcttcgacttcgtgggggagaccaacgcagtggacgtatacatccgctttctgcgggccaaaatcgacgagcacttcggtatcaagctcatccacaccgtccgcggcgtgggctatgtgattcgggaggaaggacaatgaacgcggccgccatcgtctacaccagccagaccggcttcaccgcccggtacgccgccctgctggcggagcgcaccggcctgccctgccgcccgctgaaggaggccgccgccctgccccgggggacggcggttatctacctgggctggctgtgcgctggggggatcaagggcctgaagggggcccgccgccgcttccggacggcggcggtgtgcgccgtgggcatggcggcggaggtggaggaggccaagctgcgccgggacaaccggctggagggcgttcccctgttctacctccggggcggctacgccccggagaagctcaccggcttctaccgcgccatgatggcccccatggcccggctggtgtccagggccccggcggagacggaggccgaccgggccatgcgggacgccttccgggacgggggcgactgggtttccccggagcgtctggcgcccgtgctggcctggctggacggggattaggaggagggagttcccatggcacacagagcgaacaagcgcccgccggggcgcatcaagtcctccatcgtggcccggctcaacacgcgcctctttttccggctgctgggcatctatttcaccatggatctgctgctgctgttcctgttctgcggcggcctgttcgtctggtcggagcagcaggcggcccagatcagcactctggtggaggagcggggcgtcccctcggcggaggccacggagtggatgacggcaggggattacaccgtcaccgccggcacgccggaggcggacggcctccgcctgcccggctggctgccctcgccggaggagacccggggcggcgtgcgctacttcaaccccggcacggtggatctccttctgctggtcaccttctcctccggcgacgccaccagctacaccctccagatgccgggggacgagccctacgccatccggctggatctgacccagcccgcagccatcttcgtctttgccgcccgggtgttgttcatctgccagttggccagcctggtgaccaacctgttcaagaacgccggctccattaagaaggtactccgccccatccaggagctggccgccaccgccgccaagctcaaccaggtggagcgcatgtcgccggaggagctgaaggccctggcgggcaagctggacgagatcaacgccacccatctggaccggcgcatcgacctgcccggcacccagaaggagctgaaaaccctggcccaggccatcaacgccatgctggaccgcatcaacgaggcctaccgctcccagatgcgcttcgtctccgacgccagccatgagctgcgcacccccatcgcggtgatccagggctacgccaacctgctcaaccgctggggcaaggacgaccccgccacccgccaggaggccatcgacgccatccggcaggaggccgactccatgaaggagctggtggagcagcttctcttcctggcccggggggacaacgactccatgcacattgagatggagaccttcgacttgaccgaggtggccgccgaggtgctcaaggagaccgggatgatcgaccagacccacaccttctccgcccggtgggagggggccgtgccggtctgcgccgacgtgggactgaccaagcaggccctgcgcatcctagtggacaactccatcaaatacacccccgccggagggcacatcaccctgtccgccgccctgcgggacggcatggcccgcctctccgtccaggacgagggccagggcatcgacgccggcagcctgccccacgtgttcgaccgcttctaccgcaccgaccagtcccgggcccgccagaccggcggcaccgggctggggctggccatcgccaagtggatcgtggaccgccacggcggctggttcgaggtgcgctcctggcccggcgtgggcacccgcatgaccatcgttctccccgtcgccgagctggatgccggcggtgcggacgaagatgcggagcagacccgcccggcgtaaaagaaagcccctgaagggccggcctctcccttggagaggccggccctctttttttacgaatctggggaacttttttcctccctctgccgtccaagagagcgagtaccacaaaacaaataaaggagcgtacccatatgaaccgacgttttctcgccctggccctggccgggacgctgtccctgagcctgctggccggctgcggcagcagcaaggagcccgccccggagagctcggcccccgtggtggagtccccctccgcctccccggaggcgtccccgtcccccgtcctgcccaccgacagcccggcggccctccccgagaccacgccccccgcggaggagactccctcccaggctccctccgccgcacccagcgccaaaccctccgccccggtcgccacccccaagcccacgcagaagccgacttccacgcctacccctgagccggtggagccggagccccaggtggacgcggtgcagtccacctggaatgacatctccaagctggacattccctccctaaccgacctggacgatgccactctgaccgccctgtacggcattgatcccgctgatctggacagctatctctgcaagatgcctatggtcaatgtgcaggccaccgagttctttatcgccaaggtgaaggacggcaagatggataccgtgaaggccgccgtggagaaacggcaggatgatctggaggcccagtggtcccagtacctgcccgagcagttggagctggtacagaactataagctggtgaccaacggcaactacatcctcttcgccgtcagtgagtacgccgacgaggcggtaaccgcatttaacacctatacaaagtaattttttgcgggtataataagggtgcccggcagggcaacctgccgggctttttctgaagttcacaagagagttggtggttcgttggtcttttccagcctgtatttcctgtttttatatctccccattgtattatttctgtactatattacgcctttgaaatggcggaatctgttgctgttgctggtcaacctggtgttctacgcctggggagagccggtctatatccttatcatgttcctctccatcggcatcgactacacccacggaatgctggtggagaagtacaagcgcaggggcaacgaccggggggcccggtgggcggtggcctcgtcggtcatcttcaatctggctctgctgttctttttcaagtactgggacttcgttgccggcagcctccaagccatcggtttttccttcatgccgaagctaggcctgagcctgcccatcggcatctccttctacaccttccagaccatgagctacaccatcgacgtgtaccgggacgacgccaaggtgcagcgcagcctcgtcaacttcggcaccttcgtcacactcttcccccagctcatcgccggtcccatcatcaaatacaaagatctgggcgaccagatcgaccaccgcacccactcccccgagcagtttgcctccggcgtgcagatcttcgtggtgggcctggcgaaaaaggtcctgctggccaacaacatcggcaagctgtgggataccattctggccctccccgccggggagctcaccactgctggggcatggctgggcgtggccgctttcgctttccagctctacttcgacttctccggctactccgacatggctgtgggcctgggccggatgctgggcttcgagttcatgcgcaacttcaactacccctatatcgccaagtcggtcaccgagttctggcggcggtggcacatctccctcggcacctggttccgggagtacctctatatccccctgggaggcaaccgggtgagcaagccccggctgtttttcaaccttctggtggtgtgggcggccaccggcatctggcacggggcgagctggaacttcctcatctggggactctacttcgccgtcctgctgattttggaaaaggctttcctgggcaagctcctccagaagcttcccgccgccctccagcacctatacaccctgtttctggtactggtgagctgggccatcttcgccgtggaggacttcggccatatgggagcctacctcaaggccatgttcggcctgggcggcggcctgacaaacgacaacgtatcgtattattttttctcttttctccccatgcttatcatcgccgctgtggcctccaccccgctggccgccaagctgtggaagcgcctgcccgaaaagcccaggctggcgctcctccccattctgctgctggcagggctggtcttctccaccgcctacctggtggacgccacctacaaccccttcctctacttccgattctgactcaggaggcaagccatgacaaagaaatactgcatcttcctctccgccctgttctgcgcctttctcggggtgttcctggtggccaatgccgtctcgcccgaccgcaccttctcccagatggagaaccgcaacctggagcagctccccgtccccagtgtcaaaaccctgctgaacgggcagtttatgaaggacttcgaaacctacaccaccgatcagtttgtggggcgggacggctggatcgccctcaagtccaccaccgagcgtgtcctgggcaagaaagagaacaacaatgtctattttgccgccggtgacaccctgatctcccgcttcgacgagccagacggggaaaaggtgacgaataatctgaattatgtgaacaactttgtggaaaatgtggatatccctgtgaccttctccctgatccccacccaagcctgcatctgggccgaccggctgcccgccggagcccccaacgccagccagaccgccattctggagcaggccaaggcttccgtgcccggtgcgtcctgggccgacctctacacccccctgtgggagcacaagggcgaggacatcttctaccgcaccgaccaccactggaccagcctgggggcttactacggctataccggactggccaccgccctgggctacacccccgtacccctgaacgactacaccgagaccgtccgctccaccgagttctacggcaccgtgttctcctcctccggcgtgcggtgggtgcgcccggacaccatctctacctacgtgcccgacgacggcatcaccgtggcgagtcacacctacgacaacaagggcaacccggtggaggaaccccggcagctctacgacacctccttcctctccgtcaaggacaagtactccatgttcctgggcggcaaccagcctttgggcgtcgtaaagaacgccaacaatcccgacggccccaggctgctgataatccgggactcctacgccgactccctggtgcccttcctcaccccccacttctctgagatccacctgctggatctgcgctactacaagctctccatcgccgactatatcgcccagaacggcatcgaccaggctctggtgctctacagcgtgcccaacttcgtcaccgacagcaacctgctctggattgcgaaataagccgcaaaaaatcccccgctccttagagagcgggggatttttgatcagctctgcggatttcagtcgcgctgggagtggcggttcatggagtggttcagcttgccgatcaccagcaggactactaccatacacacaatggcaatggccagattgataaccacattctgaataaaggatgccagaatgtagtttgcgaagcacacgacggccaccgtcatggcgtagggcagttgagtcgccacgtggttgaggtggtagcattgggcgccggaggacgccatgatcgtggtgtcggagatgggagagcagtggtcgcccataaccgcgccgcccagggtggccgcgatggcgatcatcagcatatcgttgccgttgatcagttccgaggtcagatcggcagcgggaatgccgccggagaacaccgggatgacgatgggcagcaggatggtgaaggtgccccaggaggtgccggtggcgaaacccaggaacgcggcgatcaggaacaccacggcgggcaggaagttcttcagaccggggccgaacttggacaccaggtccgccacaaactcgggggcgccgagggccttggtcacatcgccgatggtccaggccaggcacaggatcaggatggcgggcaccatctgcttgaagccgttgggcaggcagtccatcagctcagtgaagctcatggcccggcgcaccatgaagaagagcatggtaaagatcagggcaaccagggagccgagaggcagggcgtcaaaggcggaggtattggcgaaggcggtgatgaggtcggtgccgccgttctggtagcccacatagaccatggagcccacgcagcaccccaccagcacaagcaccggcagtaccagatcaatgaccttgccattgggattgaacttcatctcttccacaccggcaaaggggcgttcgggcgtggtgtagaggtcgcccttagcggcgttgttctcatgcttgcgcatgggaccgtagtcgatattcaggcaggtcatcacaacgatgaacaccagggtcagaatggcgtaatagttgtaggggatggctttcaggaagatctggaagcccacctcctcgttgccgatgataccggtgacagccgccgcccaggaggagacgggcatcataatgcacacaggggccgcggtggcgtcgcacatataggacagcttggcgcgggagatgtggtggccgtcggtgacgggccgcatcacattaccggtggtcaggttattgaagtagtcgtccacgcccagcacgatggccaggatgaaggtggaccacagggcgccggacttggtcttgatatggctcacagcccagtcgccataggccttggagccgccggcccggatcatcagggctaccatggtgcccagaatgaccaggaacatcagaatgcccatgttgccgccggcattggatgtcaggcgggagacaaaatcctggaacgcatcaatggggctgccgttggtatacaggaagcagcccacgataatgcccaggaacaaagacgaatacacttccttggtgatcaaagccaggacgatggccgccaccggcgggagcaaggatgcgacggtgccccagacaaagctggtatgctccacgtcgccctcggcaaatgctgctgtcatcaggacacatacaagtgcgaaaatgaccagcaggaattggccgaaccgtttcatacgtggtgaattcataatggccctcctatgaaattgtgaatcctaaaagctccccaacccaaggactcgagggctatcatacaagattgttaacagtttgacaatagatttttgcaaatcttaacacactttgtcaatatccgacagaattatcgctaaatttttgtaaataaagtcatgtgctgcgcaaaacccccccgctcttggagcgggggggtttttatgtaagagttaatcgcgctgggagtgacggttcatggagtggttgaccttgccgatcaccagcatgacaagcaccatagagacaatggcgatgggcaggcagatgaagggaacctggataaacgcggtgatgatatagttgacgaaggccacaaccgcgacggtcacagcgtagggcagctgagtggccacgtggttcaggtggtagcactgagcgccggaggacgccatgatcgtggtgtcggagatgggagagcagtggtcgcccataaccgcgccgcccaaagtggcagcgatggagatcatcagcaggttgttgttcaggtcacccacggtcagatccacagcaggagtaccgccggagaacaccgggatgacgatgggcagcaggatggagaaggtgccccaggaggtaccggtggcgaaacccaggaacgcggcgatgatgaacactacggcgggcagcagggcatacaggctgccgctgaggttcttcacgatgccggccacaaactcgggggcgccgaggcccttggtcacgtcgccgatggtccaggccaggcacaggatcaggatggcgggcaccatctgcttgaagccctcgggcaggcagtccatcagttcggtgaacttcatggagcggcgcaccatgaaataaatcatgttgatgatcagggcgatcagagagcccagaggcagggcgtcaaaggcggaggtgttggcaaaggcggtgatgaggtcatggcctccgttctggaagcccacatagatcatcgaggacacgcagccgatgatcaggataataacaggaatgaccaggtcgatgaccttgccatcgggattaaacttcatctcagcggcattctcaaagggacgctcaggcgtggtatagaggtcgcccttggcggcgttgagctcgtgggtgcgcatggggccgtagtcgatgttgaggcaggtcatcacaatgatgaacaccagggtcaggatggcgtagtagttgaaggggatggcccgcaggaagatctggaagccgacctcctcattgccgattacgccggtaacggccgccgcccaggaggagacgggcatcatgatacacacaggcgccgcagtggcgtcgcacatgtaggacagcttggcgcgggagatgtggtggccgtcggccacggggcgcatcacgttgccggtggtcaggttgttgaagtagtcatccacacccagcacaatcgccaggatgaaggtggaccacagggcgccggatttggtcttgatgtgggacacagcccagtcgccgtaggccttggagccgccggcccggatcatcagggccaccatggtgcccaggatgaccaggaacatcaggatacccatgttgccgccggcattggagcacaggtggctgacaaagaactggaacgcgtcgatgggattgccgttgacctgcaggaagcagccaaccaggatacccaggaacagcgacgagtagacttccttggtgatcagcgccaggccgatggccacgacgggcggcagcagggacgcgatggtaccgtgaaccgcgctgacaacctcagcgtcaccttctgcgaatgcggctgtggtaagaacacatgcaagggcgaatacgacgagcaagagtttcccaaagcgtctcatgcgtggtgagttcataataaccctcccttttttaatgcgaatcctaaaagcctccccaaccctaggattcgtaccttatgatacaccatcatttacaatttggcaatactttttcgtcaaatttaatatataccatcacactttagtaagtcaaatttcacatattaagcaaaaagttctcagcttccagtgatttcctcactctgcggaacgttttctcatccgggcagcgaaccgtgtgcaggtggattccgccggtcaatgctgagagcggacgggctccgtgctcctccacccgccggacgaactcagccacgtcgtaccgggagcgcacccccagcagtccggtgagctggccgtaaaccgggtgctccacgattacgtccaccacctcgcccccggcgtccacgatggcgttgagctcccgctccatctcctccggagcgtgaacacaggccacggtgcgctccacgccgcctccccgtccgcccaggagatacccccggggcgtggccaggatatccgtccctccggcccggagcagggccacatcgcccacgatgatctgccggctgacggagaagcgctcggccaaggcggcggcgctcaccggccccacggcctcctccagcgcctgggccacggcctgccgccgggcctgcgcggctgacattgacatgtgacaattccccctttcttctcccagtataccagttcccgctccatctgtaaatcatcttgctttttccccggcgtccggttagaataaggttgatcgtttgctggaaaggagctgtggcaatggatcgtgaggaagcctttgaatttctggaccggacggcccgcggcatcgcggagatgttcggctccacctgtgagaccctggtccacgacatgggggacccccgccaccccatcctgtccatctacaacgggcacgtctccggccggaccgtgggctccaccctggacatcctgggcaccgccaaggagctggacgaggacgctctggtaaccgacttcgtcaatctctacgccaccaccccatcgggccagcagatcaagagcagcaccttccacctcatcggggagggatacaacctggcccttggcatcaacttcgactacagctccctggtgtacgccaaccgcattctggtggacctcatgagcgcggaggccgaccttcagagcgccctgtggcacggcggggacagccgtctggccgatgtctttgacgagtgtctggccgccgttggcaagccggtcagcgccctgaacaagcgggaccggatgaagatcatcgcccttctggaccaaaagaacgctttctccttccgcaagtcggtgccttttgtggccaagcggctccaggtctcccggtatacggtctataaatacctgggtgagctgaccggcgcccatgcggaggagagcgaggaggaataacgccatgtacgaggaaaaaatcaacgcctattttgacgcccctgagcgccgggctgagctggtggaggccatctcccggctggtacgcattcgcagcgtgcgggaggagcccttgcctggcatgccctttggccccggccccgccgccgccctggcggagggtctgaagctggccgaagagctgggctttgccacccgcaactacgataactacgtgggcaccgccgatctcaacgacaaggagaccgcccttcacattctctgccacctggacgtggtgggcgagggcaccggctggacagtgacggagccctatgtgcccaaggaggtggacggcatgctctacggccggggcaccgacgatgacaagggccccgtggccgctgtcctgctggccatgaaggccgtgaaggagctgggcgtccccctccggcgcaacgcccgcctgctgatgggcaccgacgaggagagcggttccagcgacatcgcctactactacgcccgggagccctacgccccctatgccttctcccccgacgcggagttccccctcatcaacatcgagaagggcagctataagccggtgttcaccaagtcctggcccgcggagaccgccaccccccgggtgaccgagttccgcggcggcttccgcatcaacgtgctcccgccggaggccgagtgcttggtggccggcctgtccgccgacgccgcccgcccctattgcgaccgggccgccgccgagaccggcgtgcgctacgagctgcgcgaggagggggacagcctgcacatcctctgccgcggcaagggcgcccacgcctccctgccggaggagggcgtcaacgccatcaccggcctgctccatctgctctgctcccttcccctggccaaggtgggctccaccgccgccctccgcgccctgagtgccctcttcccccacggcgactgcgccggcaaggccctgggcatcgcccagtccgatgagctgtccggggcgctgaccctggccttttccctgctgaccgtcaacggtactggcctggagggccagtttgacagccgggtacccatctgcgccaacgatgagaactgccgcgccgccgcagaggcatctttttccaagtttggcttttccgtctccggcgagatggacgctccccaccacacccccgctgactccccgctggtcaaggccctgctcaagtgctacgagcagtacaccgactacaagggggagtgcctggccattggcggaggcacctacgtccacgatattcccggcggcgtggctttcggctgctgtatgcccggttttaacggcaacatgcacggcgccgacgagcacacctgcattgccgaccagctaaccgccgccaagatctttacccaggccatcatcgacctgtgcggctgagtccgccttcagcccccttgagcaaagcccatgggctttgctgcggcaattccgccgcagcaaagcccatgggctttgctgcggcaattccgccgcaggccgttccccatccggtccgcgccccggcgcgtactatataaaataaagagaaccggaactcaaaaaagagaagagaaagcgaggaacccctatgcgcaaaatctggaaacgtgttaccgcagccgctctgtccctcaccttcgtcctatccctttccgcctgcggcggcggtggtctcagcgccgacgatgccaccacgtatgttcagggtattctggacgagaactacaaaggcgtttatgatcccgacttcctggagctgatcgacattaccgagaatgaggctgaggaaacctacctgtccagcctggagaccgaggctgactttttcgcctccgccttcctgatcgacgacctgaccgacgaactcaaggccgaggtagttgacatgtataagcaggtctacgccaaggccaagtacaccgtggataccgccacggaggtggacgacagcaccttcggcgtcaaagtcactgtggagcctctggacgtatttgaccgggttgccgaggccctgtggggcgacacccccgacgcccgcgccgaagctctctacagccaggacgtggactccatgaccgatgaggagtacgccgcttatgacgcggagtggtgccgcctggtcatcgacctgaccttggaaaagctgcccgaggcggagtatctggaggcccagagcaaggtggtgcagatcaccctgggcgacgacaactactggtccctggatgagcaggatttcagcgacctggactggctgatccttgactacaacttctgagtacacatgcgccgcagattggtttcagtctgcggcgcttttgcgttacatggggcatctgtcatcggaaaaatggcccgcgccagatgccgccccgaacggcaggccgtacacttccgcacatctgtgtgagtttatcacagacggcagccccgtccatcccctatactgggcgcatctcagtaaggaggttgcctatggatttgcaaaaacaccaccgaagaacggcaaagatcggggcggattgcgtggcctgcggctactgtgtccgcgtctgtcccctctccgccatccgaatctggaacggtatcacagcccgggtggatgcagcccgatgcgtcggctgcggcaagtgcgcggcggagtgcccggctaccataattacactggaggagaatcgcccatgaaaaagcgctggtatgactttctctggatcgcctctctcctctatctggtgttgggcttcttcaacatcctctttgcctggttgggcctcctctgctttttcatccctctggtcatcgcctttgcgggcggggacaagggctactgcaaccgcttttgtggacggggacagttgttcagcctgctgggtggacgcttcggcctctcccggcgggccgatattccccggtggatgaaaagcaaggcgttccgctacgggtttttgggcttttttctgctgatgttcttccagatgctctggagcacatatctggtctttgccggcgcgcaggagctgcgccaggccgtcactctgctttggacgttccggctgccttggcactgggcctactatggaaccctcttttcccccggcgttgcccaattcgcctttggcttttacagcgtcatgctcacctctacggtgctggggctggtcacaatggtgcttttcaaaccccgctcatggtgtgtgtattgccctatgggcaccatgacccagcttatctgccgggggaagcaccggggagaggccgccctccactccccggcagaaggtagttgacattttcccctccgtcccgtatactataaagtatagaagtcctactgaagttcatatggtcggatgatggggtggggagagcgcggcacaccgccgccgccgaaggggcagcgcagtgatctctcaggcagaaggaccggccccggacgaggctctggaaagcggaccgcagtccgcgccgacgggggcaaaactctcaggcaaccgaacagaggcgcatggcagcattgccatgcgctttttttgaccccaattttaaaggagggcatggaaatggaacgcaaaactccgctctacgaccgccacacggcggcggggggcaagctggttccctttgccggatggctgctgccggtgcagtactccggcgtcatcgccgagcacagggccgtgcgcaccggctgcggcctgttcgacgtcagccacatgggagagctgctcctccggggccccgacgccctggccaacctcaaccggctcatgaccaacgacttttccggcatggcggacggccaggcccgctattcccccatgtgctacgaggacggaggcgtggtggacgatctgatcgtctaccgctgttcggacacggcctggctggcggtggtcaacgcctccaacatcggcaaggaccgggattggatgaccgcccacctggccggggactgcactttggaggatctctccgatcagacggcccagctcgccctccaggggcccggtgcggaggcgctgctgcgcaccctgacggcggaccttccggcgaagaactacaccgccgtgctccacggcacggtggacggccggccctgcctggtctcccgcaccgggtacaccggcgaggacggctttgagctctactgcgccccggcggacgcccccgccctttgggacgcgctgacggccgccggggccctcccctgcggcctgggggcccgggataccctgcggctggaggccgccatgcccctctacggccacgagctctctccctccatcaacccctacgaggcggggctgggcatcttcgtcaagcttgagaagcccgacttcatcggcaaggccgccctggagcgggcccgccccgtgtcccgccgccgggtgggtctccagatgaccgggcgcggcatcgcccgggagggctgcccggtgtacgacggcgggcggcaggtgggcgtggtcacctccggcacccactgcccctgggtggggcaggcggtggccctggccctggtggacgcggcgtacaaggaaccgggcaccccgctccaggtggacgtgcggggccgccgggtggacgcccaggtggtcaaaacgcccttctaccggcggggataagggtaaaccggccacgccggctgccgccccttcccagctcattttataaaaacaattttaaattatacaggaggttattactatgaacattcccgaggaactgcgctataccaaatcccacgagtggctcaaggaggaggacggcgtctgcaccgtcggcctcaccgacttcgcccagcacgccctgggggatatcgtctttgtcaacctgccccaggagggggaccctgtcaccgccggggaggccctcggcgatgtggagtcggtgaaggcggtgtccgacgtgctctcccctgtgtccggtgtggtaaaggcggtcaacgaggagctgctggacaatcccgccctggtgaacgaggacccctacggggcctggctgatccaggtggagcagatgaccgatgaggaggagctgctggacgcggcggcctacgaggcccactgtgccgcggaggagggctgacatggccggatatctgcccgccgcggcggcggagcgggccgcccagtacgccgccctgggcctgtccggcccggaggcgctgtaccgggacgtgccggagtccgtgcgcctcaccgcccccctgaacctgccccctccccagtcggagctggaggcccgccgcaccctggaggccctggcggagcagaacctccgcttccgcaccatcctgcggggggccggggcttacgaccactacatccccgcggcggtgagccgcatcgcctccaaggaggagttcgtcacggcctataccccctatcaggcggagatcagccagggggtgctccagtccatcttcgagttccagaccatgatctgtgagctcaccggcctggacgcggccaacgcctcggtgtatgacggggcctccgccgcggcggaggcggtggccatgtgccgggagcggaagcggacgagggccgtggtgtccgccgccgcccacccggacgtgatttccactatccggacctacagcttcggcgcgggtaccgaggtggcggcggccccggcggaaaacggcgtcaccgatctcaccggactgctggatgagaccaccgcctgcgtctatgtccagcagcccaacttcttcggccagctcgaggatctgcccgccctggccgcccaggtacacgccgccggggccagactgatcgtcggggtcaaccccgccgccctgggggtgctggagtcccccggcgcctgcggggcggacatcgccgtgggcgagggacagcccctgggcctccccctgtcctggggcgggccctacctgggcttcatggccgcctcccagtccctcatgcgcaggctgcccggccgcatcgtgggagagacccgggacagccggggagagcgggcctttgtcctcaccctgcaggcccgggagcagcacatccgccgggagaaggcctcgtccaacgtgtgctccaacgaggcgctgtgcgccctcaccgcctccgtctacctgtccctcatggggccggacgggcttcggcaggtgggcgagcagtgccacgccaaggcccactacctggccgcagagctgtgccggctgcccggcgtgtccctgcgctaccccggccccttcttccacgagtttgtcaccgatctgcctgaaccccagaaggtgctttccgccctggaggcgcgcggcatcctggggggctggccggtggagggcgggttgctgtggtgcgccacggagaagcagagccgtgccgagctggacgaggccgtgtccattgtcaaggaggtgctggacagatgaagctgatttttgagcgcagccgccccggccgggggaacgaccttctgccgtctctggacgtgcccgccgcccccctgccggagaagtaccggcggaaaacggtcccccgcctgccggagctgggggagagcgacctgtcccgccactatcaggccctcgcccgccgggccttcggcgtgtgcgacggcttctaccccctgggctcctgtaccatgaagtacaaccccaagctgggggaggaggccgccgccctgcccggctttaccggcctgcaccccctccagcccgcccacaccgtgcagggcgctcaggccgtcctggcccgggcagagcacctgctctgtgagatcaccggcatggatgccgtcacccttcagcccgccgccggagcccacggggaattcctgggcctgctgctcatcaaggcctaccaccacagccggggggacacgggccgcacggtgatcctggtgcccgactccgcccacggcaccaacccggcctccgccgccatggcgggcttcaccgtcaaaaacatcccctccacccccgaggggctggtggatctggaggccctgcgggccgcctgcggccccgacacggcggggctgatgctcaccaatcccaacactgtggggctctttgagaaagacatcctagcgctcaccgccctcgtccacgccgccgggggcctcgtctactacgacggggccaacctcaatgccatcatgggggtggcccggccgggcgacatgggcttcgacgtgtgccacctcaacctccacaagaccttcgccaccccccacggcggcggcggcccgggcagcggcccggtggggtgcaaggcctttctggcccccttcctgcccggctccgccctgtgccgcaacggcggtgagcactccatcggccaggtgcgggccttccacgccaacttcctggtggtcgtcaaggccctggcctacctgctgcggctgggaaacaccggcgtggccgaggccgcccacacggcggtgctcaacgccaactatctcaaaaggaagctggagaaggcgggctataccgccgccttccccggcctgtgcatgcacgagtttgtgctcaccctggaggagctgaaaaaggagacgggggtatccgccctggacgtggccaagtccatgctggacgcgggcatccacccgcccaccatgtatttccccctgatcgtccacgaggcgctgatgttcgagcctaccgagaccgagtcccccgagacgctggacgaggcggcggcggtgctggcggagattctgcgccgggcgaaggaggagccggaggccctccacgccgccccggcgagcacgcctgtgggccgccccgacgagaccgccgccgcccgccgcccggtggtgcggtacgccttcccggagggttgagccgtgcatgagctgattgtcatcggcggagggcccggcggctgcgccgccgccctccgggccgcgcagggcggcctgtccgtggccctctttgagccccgccaggtggggggcacctgcctcaaccgggggtgcgtccccaccaaggccctcctccacggggcgggaccgggctgtgactggcccgccctggccgcagaggtggagcgggtggtgtccaccctccgcgccggccaggagaagcagctccgggccgccggggtggaactcatcccttaccgggcggtggtcaccggcccccacacggtggaggcggggggcgcggcctacgaggcggcccacatcctggtcgccgcgggttccgagcccgccctgccccccatccccggcctggacacacccggtgtagtcaccagcgacggcctgctttccgatctgcgtcccctggaccgtctagccatcatcggcggcggagtgatcggggtggagctggcgtgtgtctgggccgccgcaggcgcccgcgtcaccatcctggaggcggccccccgcctcctgcccaccctggagcgggagctgggccagagtctggccgcgcagctcaggcaggacggggtggaggtgttcaccggagccggcgtcaccggcgtcgcccccggccctgccgtcgccttcacccaccggggagaggcgcgccggctggaggccgacgctgtcctggtggccaccgggcggcggcccgccaccggcggcctctttgccggggacctcctgccggagctggagcgggggttcctccgggtggacggacagttccgcacctccatcccctccctctatgccatcggggacgccatcggcggggccatgctggcccacaaggcagaggcggaggggcgctttgtggccgacctcctgctgggccgcacccccctccgcggagtggcccccatccccgcctgcgtctacaccagcccggagctggcccaggtgggactcaccgccgacgaggccagggcccggggcatcccctgtgccgccggcaagtgtgtgctggggggcaacgcccgtaccctcatcgaggggggaaagcggggctttgtcaagctggtatttcaccgggagagccgcgccctgttgggggctcagttgtgctcttaccgggccaccgatctgatctccgagctcgccttggcggtcacgctggagctgacggcggagcagctgctccgcccggtgcgcccccatcccacctttgccgaggccatttccgaggccgtggaggcggcttttcccctctcctagccccttttttccacaaagaggcgtccgctgccggcggacgcctcttttctttccacattcactccctcaaattcgaccattctcgccgttatctccccttcttcgcgctttcgttgacagaagtcctctctgcgggtgacataaccgccctcccgtgtcgaaacctgcggtgatcgatcctttacaaatgctggaaaatacaatataatggtcttacggatcaaagaagaagggagcagatacaagatgagggaactattagtcgatacctgtacgggggaagaggaggacggcactgcacactccttccagtattacattctggtggacgagatggagctgagcggcggcctgtcctgcgagagctatggagttaaggtggcaggaccgggcggagaggaggcatcggtgcccaacatcacggtcagcgtggagcgcattgaccagcttctggagctcctccggcgcaactgcgtctcccccgtcaccctgcgggacgtggttcttgattggctttaaaagtacccgttccgccatgacacaagggttacgcgccgcttttgattgacataccttccaaaatccgctattatgtgtgtaatgccgcgcgtgtggcggctgatccaaggagggtatgcaattgtgaaagagagagagacctttgcgtcccggctgggctttgtgctcatctccgccgggtgcgccatcggcctgggcaacgtctggcggttcccctacatcgtggggcagtacggcggcgcggcctttgtgctgatctatctgctgttcctggtcatcatgggcctgcccatcatggccatggagttttccgtgggccgggccagccggaagagcatcctggcctcctttcaggtcctggagcccaaggggagcaagtggcactggtacggctggttcggcatggcgggcaattacctgctgatgatgttctacaccaccatcgccggctggctgctgctttacttcttcaaggtggctgccggcgaattccggggcctggatgccgccggtgtggaaaacgctttcggcgccatgcagggcaacgtaggaattcagcttctgttcatgggcatcgtggtggtgctgggtatgctgatctgcagccgcggcctgaaaaacggcgtggagaaggtcaacaaggccatgatgctctgcctgctggccctgctggtagtgctggccgtccgcgctctcacccttcccggtgccatggagggcgtgaagttctacctggtgcccaacttccacaacctgatgtatgatgccgacggcagctttcggctgttccgcgccatctatgacgccatgggacaggccttcttcaccctcagcctgggtattggcgccatggccattttcggcagctacatcggcaaggagcgccgcctgttcggcgaggccatcaacgtgggcgttctggacacctgcgttgcctttgtctccggcctgatcatcttcccctccgccttcgctttcggcgtcaaccccggccagggccccagcctgatctttgtgaccctgcccaatgtgttcaacgccatgccgggcggccagctctggggcgcgctgtttttcgttttcctgttctttgccgccctgtccaccgtaaccgccgtgtttgagaatatcctcgcctgctggatggaccgcttcggtatctcccgtggcagggcggtactggccaatctggtgctcatcttcctgctgagcctgccctgtctgctgggcaacaacctgtggagcggcgtgaaggccctgggcatgggcattatggactgggaggatttcctggtgagcaacaacctgctccccatcggctccatgatctacctgctgttctgctgtgtatccaaaaagtatggctggggctacgaccacttcctggaagaagcaaaccagggcagaggcgtccgcttccccgcccagttccgcctctacttcaagtacgtcctgcccgtcattgtgctcatcatcttcatcatgggctactgggacaagttcaagccctttatcgtggccgccctcggcgcctaacgactaaaaaaactcctgccggactcatccggcaggagttttttcacgctccgcccaggtgtagaggaggacagctcccagcaccgccgcgcctccggcaagctggagtggaccgggcacctctccgaacagtgggatggccgccagggaggagaagaccggctcacacagctttgcggcggacacgtaggatggggacaggtacttgaggcaccagctaaacaggctgtgtcccaggagagtgcacagcaccgccaacgccagaccgatgagccactcccggccgccgtagcccgtcaggggcgtccccgccgcggcggtgcccaacagcagggtgagaaagcaggccagataggtcagaaaggtgtagaccgtggtagacagatggccccgctgtatccgtccgatgagggtatagacggcggcggccgaggccgcagccagggccagcaggttgccggacagctcccctgccccgccgcctccggagagggccagcagggcgctgcccccaaaggccaggagaatggcccacacccccagccgtgggatttttccatgcaggaacagggcgaagcccagggcggtgaaaatcacctcggtgctcaccagcaccgtggaggaggccacgctggtacgcttaagggactcaaaccatgtgaggaagtggagtgcaagcagaacgccgctggccccgcacaggaccaaatcccgcgccgtcacccgcctcagttccgcacggcaccgcaggagcactaccggaagcaacaggagcaccgtccagcccaggcggtaggctgcggtcaccccggacggcgcctgggaaaaccgcaccagaatggccgaggcggagacgcccagcacacccaccatgagaatcagttttgcgttccgctccgctatggaaccctcccccgctgtgatagaaagcggaggccctccggggagggcctccgctgtattggtggcgcaatgtgcctcttacttcgcggccttggcggcgcggatggcctcgatgagcatgggggtgaccttgtagaggtcgcccacgatgccgtaagaagccacgtcgaagatgggggcggactcgttcttgttcaccgcaatgatgcactcggagtcctgcatgccagccaggtgctggatggcgccggagatgcccagggccacatagatgcgggggtgcacggtcttgccggtctggcccacctggtggtcggcggagatccagcccgcgtcgacacaggcgcgggaggagcccacgacgccgcccaggacgcccgccagctcctcagccagcttgatgccgccctcgacgtccttgctgatgccgcggcccacggaaaccaccacgtcggcgccgatcagatcgaccagcttcttggcggccttcttgacctccagcacatccacatggatgtcggacttgtccagcttcacgtccacgttgacgatctccgtcttcgcggcgccggcctcgtcgtagggctgggtctgcataacgccggggcgcacggtggacatctggggacggaagcgggggcagatgatggtggccatcaggtgaccgccgaaggccggacgggtcatcttcaggttggtgttctcctcgaacttggtgttgtccacgtcgatggtggaggtggtcttcaggaaggccttgtacttctccacgtccacgtccaggtgggtgcagtcggcggtcaggccggtgtgcaggcgggccgcgcagcgggggcccaggtcacggccgatgttggtggcgccgatgaggaagatctcgggcttcttgtcctccaccaggtcacagatgaccttggtgtaggcgtcggtggtgtagacgtccagcagctcgtggttgcagtagtacaccttgtcggcgccgtagccgcccagggccttcaggtagtcctccttgatgtccttgcccagcaccacgccgcacagctccacgcccaggtcgttggccagcttgcggccctcggagaggagctggtagctggtggacataatcacgccctcgcgctgctcacagaaaacccatacgcccttgaaggcggcggtatccttactatcaaaagccattgtgttgctctcctttcactctatcagatgatgtgcttgtcgttgaggatggagaccagcttctcgacggtcgccttgtcggcgccctccatcatcataccggcgcccttcaccgggggagagaaggacttgtacacattcgtgggagagcctttcaggccgatggtatccacgtcgatgaggggatcgtccttcagagtctcgtagttgtagatctccagaggcttgttgtagcactccatgatgccgcccacgctcatgtagcgggcgtcgttcagctccttcacgcaggtcagcaggcagggcgtctgaaccttgatggtcatgtagccgtcctccagcagacgcttcacggtgacggccttgttctccaccgcgatctccgccacataggagacctggggcaggtgcagcttctcggcgatctgggggcccacctgggcggtgtcgccgtcgatggcctgacggccgcagaacacgatgtcgtcctcgtccacgcccaccttcttgatggcggcggcgagaatctgagaggtggcgtaagtatcggaaccgccgaactcgcgggcggagaccagcacggcctcatcgcagcccatggccagcagctcacgcagcatcccctcagcgggaggggggcccatggagaccacaaccaccttgcagccggtggcgtccttgatgcgcagcgcggcctcaaccgcagccaggtcgtcgtggttggtgatggtggccatggccgcgcggtccatggtgccgtcttccttcaccgccaccacgccggaggtatcaggtacctgcttgacacaaacgatgcatttcatatcgtaattttccctccagttcctttagttcacgcccaggttggcggagatgaccatgcgctgcacctcgctggtaccctcgtagatctcggtgatcttcgcgtcgcgcatcatgcgctccatggggtactcacgggtgtagccatagccgccgaacagctgcacgcagcggcgggtcacgtcgctggccgtctcagccgccaccagcttggccatggcggcgtccacagtgtagggctcgtggttctccttcttcatggccgcggagtacaccagccacttggccgcctcggtcttggcgtgcatgtcagccagctggaactgggtgttctggaactgggagatgcgccggccgaactggacgcgctccttggtgtacttgatggtctcctcgatggctccctcggccagacccagggcctgggaggcaataccgatacggccgccgtccagggtcttcatggcgatgccgaagcccttgccctgcttgcccagcaggcggtccttggggataatgcagtcctccataatcagctcacaggtggaggagcccttgatgcccatcttcttctcgtgcttgcccacggagaagccggggtcggtgcgctccacgatgaaggcggagatctccttcttcttgcggccgcgcttgtcggtggtaacgccggtgatggcaaagatcacgaacacgttggcgtagccggcgttggtgatgaagatcttggagccgttgaggatccagttctcccccttctcgtccagcacggcggtggtctgctggccctgggcatcggtgccggcgccaggctcggtcaggccgaacgcgccgatccactcgccggagcacagcttgggcaggtaatacttcttctgctcctcggtgccgttctcatagatgggagcgcagcacagggaggtgtgggcggagatgataacgccggtggtgccgcagaccttgctcatctcctcgacggccatgacataggacagaacgtccgcgccggcgccgccgtactccttggggaaatagatgcccatcatccccagcttcgccatcttcttgacggtttcctcggggaacgcctcgttctcgtccacccactcggccaggggcttgacttcattttcggcgaagtcacggtacatcttgcggagcatttcctgctctctggaaaggtgcagatccatttgttgccttcctcctaagatttatatttcagaacgggcgggcgggagtcaggggctcccgcccgtcgttgctcgcatagggaactgcgtctgccctgtttactttttggagtagtcgtagaagccgatgccggtcttacggcccagcttgccggcgcggaccatcttgcgcagcagcagggaggcgcggtacttgggatcgtgggtctcgtcgtacagggtgtccatgatggccaggcatacgtccaggccgatcagatcgcccagggccagggggcccatggggtggttggcgcccagcttcatggcggtgtccacgccctccacactggccacgccggtgtagaccaggtcgataccctcgttgatcatgggaaccagaatcttgttcaccacaaagccgggggcctcattgacttcaacgggctccttgccgatggcggcggccagctcggcaatggtcttgtaggtctcatcggaggtgtgggcgccccggatgacctccaccagcttcatgacggtggcggggttaaagaagtgcatgccgatgaacttgtcggcccgcttggtggccgccgcgatggcggtgatggagatggaggacgtgttggaggccaggatggtctccggcttgcagaggctgtccagctccgcgaagatgctcttcttgatgtccaggttctcgatggcggcctccaccaccagatcggcatcggcagcggcggccagctcggtggtgaagctcatgtgggacaggatctcagccttcttggcctcgtccagcttgcccttgctcaccagcttatccaggcccttgttcagccgggcctcgctggcctggatgatctcgtccttgatgtcgcgcaccacaacgtcatagccgttgcgggcaaatacctgggcgatgtccagccccatggtaccgccgccgatgaccacaatcttcttcatagtaaaaaacctcttttctattggtttgatcagaacattccatacctggtcggacaggtttgcgatgacaggcgtcatatgtaccgcttaccggttctggaagtgcttctcagcccgcttctccaggaacgcgcccatgccctcgttcttgtcctcggtgccgcaggtaacgccgaaggcctcggcctcgaaagcggagcctgtgtggatgtcggtctgcatgcccatgcggatgcagcgcttggattcgcacacggcgatctgggcgttggcgcagatcgcgttggccagctccatggccttatccatcagctcctcggcggggtagacctcgctgaccaggccgatggccttggcctcgtcggccttgatggtcttggccgtcagaatcagctccatagccttgctgacgcccacgatgcggggcagccgctgggtgccgccgaagccgggggtaatgcccaggcccacctcgggctggccgaaccgggccttctcgctggccagtcggatgtcgcaggccatgctcagctcacagccgccgcccagggcgaagccgtttaccgccgcaatcacgggcttggacaggttctccagcttgaggaacacgccgccgccgtgcacgccgaacttcttgccgtcgatcgaggagaagcccttcatctcgccgatgtcggcccccgccacgaaggagcggcccgcgccggtcagaatcatcacatagatctcatcgtccgccgccacctggtcgataaccgcgtccagatcgctcagaacctggctgttcagggcgttcagagcctcctgacggtcgatcgtcacgatgcccacatgaccctgcttttccagcttcacaaatcccatttgttctgcctccttaatccaatatcaaagcctgcgattataatcgttatttttttaacacaaaccttcctaataagtatactgctttccacgccaacaggcaagtgaaatgcaagaaaaaagcgttatttttttatcaaaatttgtggtcaggatgcataaatcaggaaaaggccactccagatctctcaggataatcagcaaaccggccggtttttcatggcaggccagccgggcggtctccacccatacccgcagacccggcagcgcatcccgcacaggcagatcggccagggacaggaacatggggcggtatccattgccacgtggaaagcccggtatgctgggcccggtgccctcccgcagtgtttgaacaggagagccggcgcgctgctggggaacatcagggcacatggatcactttggccgccacggttggccctttcttccatactacaaagtatgaatggatttatcatacgcgcttgcggccgttttgtcaaagattttcccgcgtatgggggacaacccgtggtgaatagggtttagggaaaggagggtgcgccttgaaactcgaccgtacctctatgctctacggtaccctgatcctcacgggcaccagtatcgtctcccaatttctcgggttcgtgtaccgcatcctgctctcccggctgatcggcgcggaggtcatggggctgtaccagctcatcatgccggtgttctccgtcatcatggccctcaccgccgtgggtctgacggtggcagtgtccaacctctcctcccagtatcacgccaggggcaaccgggccgccatcgcccaggtgctccgccgctgcctggcggtatttctcctcctctttgcggcggtggctgcggtggtggtcctgctctacgaccccatctcggtctatctgctgggggacgcccgcacccagttgggcctgctgctcctgctgccctgcatcctgctcaccggggtggaaaacctgcacaagcacttcttctatggcacgggcaacatccgtccgccggcggcggtggagctgtgtgaacagttcatccgcaccggagcggtgctggggctgctggtggtctttctcccccagaacccggagcggacggtggggctgattgtcaccggcatgatcctgtgcgagctgttctccgccgttaccctgctcctgctggcccggcggcatctgaaccgggcgggcggcctgaccggcgcgccgctggagcaccggcagctcaaccgccgcatcgcctccatcgctgtccccatcgggctgaccagcctgctgggcaacctgatgggctcggccacctctgtgctcatcccccagcggctggtccacgcgggggcggaggtctcggaggccatgagcgccttcggcgtgctgtgcggcatgaccctgcccatgctctgcctgcccaccgccttcatcggggcgctgggcctggtgctggtgcccaagctggctgaaggcgccgccctggggcagcggggtctggtgcagcaccgggtagaccgctccatgctggccacctcggtgctgatcctccccgccatggcctttctggtggtgctgggccccaccctgggcgccgccctgttccgggaacccaccgtgggccgctctattctccccctgtccgtcggggtgctcctgtcctgctaccagtccgtcctcgcctccgccctcaacggcgtgggccgtccgggggccgccgcccgcaactccatcctctgcggcgtggtgcagctcggctgtaccttcttcctcatgggcctgcccggcgtgggactcaggggctatgtggcgggctttctcgcctccgccgccctgggggtactcctcaactggtgggccgtccgccgggccaccggcctgcgggcccagatttttcagtggtgcaccgcccccgccctctccgccctgctcatggggctggtgatcaaccttctgttccaggtgctccgccgcgccggcctggaggctctccccgccgccctggcctgcctgctgttcggcggcgtgctctacctggccgccctccaggctcagggcatccacctgcgccgcctgttccgcctgcgctgaaaccgctttgcaaacgtcccgctccgtgctatgatggagtgaagctgaaaaaaggagcggacgtatgggaattcggattggaatcgtcggcgcgggcaccacggtggccatcgccgaccggcacgtggagggctttctggcccaggcggggcgctgtaccgtcaccgccgtatgcagccgcaccctggagggctgccggcggctgtgtatccggcacgggcttgacggggtacggatgaccacccgcctggaggagctgctggacgtggtggacgcagtggtgctctgcactcccaaccagttccacctgccctataccgagcgcgcggtggagcggggcaaggccgtgcttctggaaaaacccctggggctccagaccgccccgccggggcaggcggagcggctgctggcccggcgggacgccagggtgatggtggcctatgtctaccgctataccgccgtggtggagcggctgcgcgcgctcctccgccagcggatggggcgggtctatctggcccaggccagccagggcggcacccgcctggccgatcccgcggtccctctggagtggcggatgcgccgctccgcctccggcagcggcgctctgggcgacttcggcagccacctgctggacctgctccaatatgcggcgggcgtggagctggccgaggccgccggctacggcggcacctttctccccacccgccggccggacggtcagggaaacacctgtgtggagaacgacgacgccttcgtgttctgcggccggggaaccggcggggcgctgtgcagcgtctccgtcagccgggtagggctggacggcatccacctgtgcatctccggcgagggcgggcttctccgcgccagtgtggaggaaggcgtcctcacttactggcccaaagccccggacggtccctacgccccggagggggaggcgcgttcggagcacctcgccgagccgcccgggctccgctttgcgcggcaggccgcggcgtttttggatctggtggagggccgcccggtggagtactgcaccctggagcaggccgtccgtctggagcgcctgctcacccgcctggaccagtccgcccaatagacaaatccccatgccgccgaagtacggcggcatggggattcccttatctctgcatcagctctcccagcagtggctcgaactggaccccctccagaaccggggtgcccagcgccagggtgtgggctgcgcaccgctggacaaactccgccgcccgctgggccgctgtctccagcggctccccccggagcatcgcccccagcaccacgctggcgaaaagatcgccggttccggggaactgggcgggctcctgtctggccatagcaaaacggatgcgccctgtggcccggtcgaagcagcccgcgccgatggcgcccggccggaggctcaccccggtgagcaccaccgagcgccgcccatccaggctcagccgctccagccacgcccgcagcccctcctcgtcccggggcagatcggcgtagtcctcctccagcagcagcgccgcctcggtcaggttgggggtgatcacgtccgcctgggccgccagatcccgcatacgcccgcacagctccggcgtgtaggtgcggtagggcttcccgtggtcccccatcaccgggtccaccagcaccagcgtcccctcccggcggaactggcggtagaagtcctcaatcagtccgatctgcccggcagagcccagaaagccgctgtagatggcgtcaaaggtcacccccagctccgcccagtgggccgccgtccccgccatctggccggtcagatccagaaaggtggccttctcgctggccggaaacgcggtgtgggcggagaggcaggcggtaagcagcgggcagcattccccgcccatggcggccaataccggcagcaccaccgtggtggagcagcggccgaagccggagatatcctgaatcgcggcaatccgcggagcacgtttcatggtcggtttcccccttgcggtttacgttcttctctattataactgcccgctccgcagagtgcaattgacaattttgcacgggaatagtatactgagttatcatgcgggcgtggtggaactggcagactcgacggatttaggttccgttaccttcatggtgtgcgggttcgactcccgccgcccgcaccatcggagtatcctccgggatactccgatttttttatttctaaaattattctaaaaaagttgtacagaaacatgcagctttttgcctgtttccccctatattatgaaaaataattttcttgtacttttaagggggaataactgttgtactataagcgatatttcggcacaatacaaaagagtgcaggactaccaagctgggtcaaatggacgcaccattcagagggcaaaactcactgtgaggaatgcttgaggctggatgactgttggtttcagaaggaaaaagctccgctttgtccgcaccatccatactgtcactgcacattagacccgattccttataccattgttgtcagcaacgctgcagcacatagcgcatacagcaaatttgacccatatttgtttaataccagaggtgaacatccacacgggaaagataaactgtttcatgaatggggctatacagttgtggatgcattttggctgcaaaaagaaatagaacgacaggcaagggaaaagtatgtatctggaaattatgaattgggaaggttaaatttcgcaggtcaaagaataagtatcagaattgaaatcccgagaagaaatggcgatggaacagtatcgtttatatcaggttggatggttgagtctaccggcgagatacgactgacaacaccgtacggaggtgaataaaatgcagatgatggattgtgttgaagtgattgtggaaaaagaaagctatgcccgggaaggcgtacacaaaggaatgcagggttggatctgttatgaacaagaagtagacggttattggctggtcaatttcccgcaatacggtgagaaaaacgatattgcagagatcgacatcaaggaagaggaccttaaatatcttcctaatggcatgaatgttaaacggaatgagcaaatcaaggcgcagtttgatgcattagaaaaagggaaaaaggcggaggatatttccgattatatgatttgattggataaaactccttgcttcccgtttacaaaccattgatattactgtattttccacagatcctttcatgacactcagaccacgtcggagcaaacgtcaaatcgtttgctccgacttttttaaaaagtcagagcgcatttattttgctgctcctccttcccaaatcacaaccgctgcgctgggttgtgatttgggatcgccgctctgcggcgtttttcgattttgcagaaatatcggttttaaccgttatttgcataaaaataaccacacctttcggtgtggttatttttatgcataccgtgaggacttcacatacccggcggaagtgaattccgcctgcgccaaggtttttgaatgcccccacccaattcgaacagtttacatgagactggcggataggggggtatagctgaaagccttatcatgacaggactttcagctatttctgtattcacttcggagatgaggcatgaaagtgcaaacgagctgaaatcgaaatacaaaatggaagatttttggaatctgccccctgtgtcataaccacattagattaatattgagttgcataaaataggaatacttgatataattacagcaatactctgggagaaaaatgtgtaaagggtggctgttatgacaggaaagcagtggtttgcgcgacagaaaaaagaacagattgcgcagctaacatgtcaactggacgcactgcttcctagtatcttgcggcgccatgccttcagcaaagacaatccagatgacttcaaatctcagcaattatccctccacgcaaaaatcggagggaagcacacgacgtatcttaatgttacagataacgtgataagctcacctgaggaatttgccgcccgttggttccaggggcttataaaccacataaagaccgtcgatgcgggaaaagaggcatccagggcggcgtataagtttcagcagcaactgacaagtgatccggaactcttagaatatgtgactctttttttaaagcgcacatattggcgcaactgcgatgccttggcaaaaaaacgccctaaaaaggaagaagcagcactttggattgggcaaacaaatgcaagctacggacttctcatcacccctcgttttaaaaatggagaatgggaaaacgatgtcagtgaaattcgacattttaaaccaaactactggaccatcggacatgtcctggagacaggacttgtcgttccccattcaccgcaaagaatagagttttttacgatagaacaatacctggtattttttcaaaatattatggttcgacaaacgagatcaccctatgaaatggagattgccaaaaagtattgcgagttggtgttaagcagcaagcagccatacgaaattccgctcttgatcccagaattgcgatatggcggtcttcagacacagcacaggtatcggttggatttcacgattattaatccctatacattgcagaaacagggatttgaattttctccctggtcaacacatgggtacttatccaggacaaaggaaaaaaatcaaaaagaaattaatttagaggccagagccaattttgaaaaagagatgcagaagcacaaagaatattaccgaaagtttaatatttttactttaatatatacagactcagacctgcaaaatctcgatcaaatatttaaagaaatgcaacagtatttaaagcctgagcacgaaaacagacagatacttgaagcgacacttgaggaattcaaacggttttctttatagaatcaaccttaatcccaagcccttatcaaaatgcattttttatcaacacaggacatgtcgccgcggacgtcatatcgtccgcggctcctttccaaaccgcaaccgctttgctgggttgcgatttggtttttggtgcagacctgcaaccactgcatcttttttgtagccatcacccggcgaagaaacctgtttttgacttcggtcaaggtcgtgtcaagattttttcgcactttagtttgcaagctctggcatgaatggagtcagccggcaatggaggcatcctcaatggcggcctccaggtgcttcatattcatgtactttttgttgccccactgggagccagctacatggcgtagccgggcacagaccagcataagggcagagttgccgtccgggaagctgcccactacacgagtacggcggcggatctcccggttcagcctctcaatgacattgttggtgcggatacgggtccaatgctcactgggaaaatcacaataggtcagagtctcctcgatgctgtcctccaccttcttagcagcctctttcagcttcatggaacacagctcctccactacggccctggccttttcacgagcggcttttttgctctcctgggcgtggatcgccttgagcattttggctaccagtttcaccttggagcgaggtgtgacagagaacacattacggtaaaagtggacggtgcagcgttggtatttggcttcagggaacacttcgcccacggcctccagcataccaaggcacttatctccaacgatgagtttcacgccgtccaggccacggccacgcagccactggaagaagttgatccaactggccttgtcctctttcatgccctcggcggcacctaaaacctcacgatatccgtcctcattgaccgcgattgccaccaggatggccacattttcaaactctccaccccagttgcggcgcagatagatcccatccacatagacatacggataccgcccgccttgcagaggacggttacgccaatcctcgatgtggacatacgctttcttgttcagctcactgatggtggagggagagaccttactgccccagagagtctcggtaatatcctctacacgccggacggatacgccagccaggtacatctcaatgagagcctcttccacgctactctcccggcggcgataccgctcaatgatggcagtctcaaaggagatccccttgagcttgggcatcttgagtgtgacatccccagaagtggtggtaaggttgcggttgtagtggccgctgcggtagccctggcgttgctcattgcgctcgtaccgggccgcctgggtcagcttctccgcttcggcctccagcagctcgttgagggtttcctctacgcttccgcgcacaagttccttgagctgccccttgataacttcttcgtttagctgtacaatcttttcggacatggtttgctgtctcctttcgaatggtggtgtcgcaacttcattctaccagacatctgcaaaccatgtctctttgtctttttgcgaaacttattctacctgacctcggtcaaagacaggtttctttctattttgactgtcatcattgtccatagaggatacggtgttttccctgcccgatccagattgaaaagaatttgtaacagctaaaaaagttatttgattagaccaaataaaattgcccgccggcatcaaatccggagcggattttccggctgctgcgcatactatcctcttttgcctccgagttatggctgcccgcacggtgtggtcttaagcgtcatctgcctccagccgggtttttcaagtggtcaaaatcttacgttgaaattctgtgactttatatgttatattagctttgattacttttacgggctctcgcaaaagagaggcacagcgtgtactgggagatatcatagtgcgtgaaaatgaatataaggagatcctgtcggcgctcttaggccttttgaatgaaggggttcatattgtggccgggcaggggacctccattttttacaattccgttatggccaggatggaacagatggagccggcagatgtggtcggccggcgttttgaggatgcgttttctcacatggatctggagtccagtacgatttaccgtgcgctccaggccggggcatccaccgtcaatcagccgcagcggtacatcaacgccagcggcaaatatattcacaccattaatactaccattccggtcaaagatgccgacgggaagctgctcgccgtgatcgaggtagccaatgacgtaactcagctgtcggagctgtgcgaccggctggcccatctgcaaagtcaggtggggacgcaggagacatccaaaaaacagaagctcaaacgctatcacttttccgatctgatcgggcgtgatcccaagttccagaagagcatggagcgggccaagcgggcggcgcaaaacgacatgccggtgctgatctacggggagacgggcacgggaaaggagctgttcgcccagagcatccactacggtggaacgcggagcgggaagccctttattgcgcagaactgcgcggccctgcccagcaacctgctggaggggcttctgttcggcaccgccaagggcgggttcaccggagcggtggaccgggcgggcctgtttgagctggccaaccacggtacgctcctgctggatgagctgaactccatgccctatgagctccagagcaagctgctccgggtcttgcaggagtcctacatccggcgggttgggggctcagaggatattccggtggatgtccgggtaatcactactgtaaatgaagaccctgtcgacctgatccgccagggaaaactccgtcaggacctatactaccgcctcagcgtggtcaccctgaatattccgcccctgcgggaacgcaggggcgatatcccctatctggcccaggcgctgattgaaaagcaccatgcgaagatgggaaagcgcctgtcggagctgccgcgggatgtgctgcgccagctcatggaatacgactacccgggaaacgtccgggaattggagaacatcctgatccaggccatgttcatgatggatggggacagcggctttacaacagagctcctggacctgcccgcgcccggcaaggccgtggaccggcgtggcacagactttcaggcgggcgagtccctgcaggactatatcgagcgcattgaggaggaaacgatacgcaccatgttcgaccgctgccgggggaacgtatcccagtgcgcaacctgtctgcatatgaagcggcagacccttcagcacaagctgaaaaaatatggaattctttattaacggcttcttgggggggcgcaaaaaagtgggcacaatgcccatttttttgcgccttgtcaacctgttttggtgcatgtttgccagagcagctcacaggccgtttcagaataaaattttgtggatgtcctctaaaccccggctaattgtccatgtaaatggaaaatataagaatttaattgaaatattatacagatcaaagggtgcgccggaaaaactggcacaccctttgctttttctatccgcagacaggacacagaacctgaaccacacgacctgtaacggaaaggatgaatgcagcatgaaaaatgtgaaggtaattctctggggactgggcgccatgggcggcggcatcggcaagatgctctgcaaaaagcagggcgtggatattgtgggcgccatcgacatcggcgccaagctgggcaagagcctgtatgacgtggtgcccggcattgagcgcggcgaccgcgaggacgtgatcgtgggcaccgccgaggaggtcatccggcccggcgccgccgatatcgtggtggtgtgcaccaactcctttacccgtgatgtctatgacaaactggtgtttgttatggagcggggcatgaacgtcatcacctccgccgaggagatggcttatccccaggcccaggagcctgagctggcggccaagctggacgagatcgccaggaggaacggcgtcaccgtgctgggcaccggcatcaaccccggccttatcatggatctgctggtcatcctgtggaccggcgcctgcgagagcgtggatcacatcgtctcccgccgggtgaacagcctgtctcccttcggccccgccgtcatggaggagcagggtatcggcctggaggtggccgaatttgagaagcggaaggccgcgggcaccatgaccggccacgtgggctttgccgagtccatccgcatgatcaccgacgctctgggctggaagctggataaattcgagcaggacatggagcccatcgtcaccgacgtggaccgcaagtccccctatggctttgccgccgccggccatgtggcgggcgttgccatgaagggctggggcaccgtggacggccaggtgaagatcgaaatggaccaccctcagcagatcgaacccgagcaggtgggcatccataccggcgactatgtggaaattcagggcattcccccggtcaacatggtcaatactcccgagatcgagggcggtatcggcaccatggccatgatcatgaactgcatcccccacgtgatcaacgcccgtcccggcctgaaaaccatggtcgacatccccgtgccccacgccatcatgggcgacatgcgggacatgatcgacgaggactgcaagctggtgaagtaaggaaccgtccaatcgacttgaaacggttacgggcccggaggagctttctcctccggacccgcggagaaaggaagctgtgaaatggttcaaaaaggaacatgggtacggattaagaagatcctgcttccagtgggccagcgtgcccctcaggatcctgaggacaccagaaataccccgctggtgatgtggacaaagggattcctagcggccgacgccaatctgggcgacgaggtgcaggtcaccacggccgcagaccgggtggagaccggcacgctggtggaggtcgacccctattacacccacagctatggcaagtgcgtgcccgagctggtgcagatcgaccgcaattacagagcattcctgtatggaggtgataagtgatggcgctggcaaaggattacgcctccgtgatgagccgcaagggcgaaattatgaagaaggccctgggcatggatttctccgcctttgagagcggctctatcgcctttgactacgagaagatgatgtcctctacggggttctccatggaggaggtagaacgggtgcaggggctgaccggagtgggcaataccccgctcttcacgctgcggaacctgaccgccctggcccgcaagtgcgccaagcccggctatggcgccaccatctgtgtgaaggatgagatgaccaacccctccggctcctttaaggcccgccgggccgcctgtgcggtggcctttgccaaggctcacggctataagggcgtcatcgccgcgacctccggtaactacggcgccgccgtggcctcccaggccgcgatgcagggcctcaagtgcatcatcgtccaggaagcctacgactcccgggaggtgggccagcccgagattattgagaaggcccgggcctgcgaggccatgggagccgaggtggtgcagatcaccgtgggccccgagctcttctatgagtccctctccctgctggaggacaccggcttcttcaatgcttccctctattccccctttggcatcgccggcatcgaaacactgggccatgagattgcccttcagtgccgcgcccagttcggcagggatcccgacatggttgtgtgcaccaatgccggcggcggcatggttaccggcaccgcccggggcctgcggaaggcgggggccggccatacgcagatcgtagccgcctcaattgatctgaccggcctgcacatggcctccgacacccagttcaaccggaagtcctgtaccaccggccatactggcttcggcgtcccgtttgccaactggccggatcgctccgacgtgccccgttctgccgcccgtcccctgcgctacatggatcgctatgtcaccgtgacgcagggcgaagttatgtgcatcaccgagctgctggcaaacctggagggcctggagcgcggccccgccggaaatacctctctggccgcggccttctgcctggctcaggagctgccggaggatcagatcctggtagtcagcgagaccgagtacaccggcgcgggcaagcatgtgcagccccagctggactttgcccgggagaacggcatcgaggtgcgctttggcaagcccggtgaggaggtgcccggcgtcagcgtgatcctgcccgccgatccctatcagttccaggtcagggatctggatctggacaagatgcgccattccctcatcaagacggccctaaagacctatacggccacccccaccgaggcggactatgagtttctggcccaggagaccaacaagagcgtggattgggtcagggagcaggtggccgctatcgtgcccacactttgagaggggagcgtgacatccatgaagcgtgccgatgattttgctgagagaagaaagcatatcgccaatctgaccgaccaggagctgtatgaccgcttctgggcgctgaccgagcaggtggttgccccgctgctggagctgggccgcaggaataccaccccctcggtagagcgtgccgtgctgctgcggatgggcatctcctctctggaaacccagaagattgtggagggctgtatggatcacagcctgatgagccacggcgccggccatgtagtctacaagctgtccagggagaagaatctctccattccggaggccggacacctgctggcccaggggaagtactgggatgaagccgccgcgctgttcaaggaggggaagtaagtatgtctgagatgaccctgaagcccaacgaaaagctggatgtacgcaacatcctcaaggatctggacaagtacgagcccaagcgccggggatggacctggcgcaagcccgcccccaacctggagatgggcccctttacctaccacgatgtgtccgagccgctgaagcagagcgtcggccttcccccggccaagtacttcggcgatatcgacccccagccgcttccggtcatcacgaccgagattgcctccggccgctttgaggacgatatccgccgcatgcgcatggccgcctggcacggcgccgaccacatcatggtcatccggcatatgggccagtcccatatcgacggcctgatggagggcaccccccagggaatcggcggcgttcccatcacccgcaagcaggtccgcgcacagcgtaaggcgctggatctcatcgaggaggaggtgggccgccccatcaactatcactcctatgtctccggtgtagctggccccgatgtggccgtcatgtttgccgaggaaggcatcaatggcgcccaccaggatccccagtacaacgtcctctaccgcgacatcaactgcgtgcgctccttcgtggacgcctgcgagtccaagtccattatggcctgggccgggatgctgcagattgatggcgcccacaacgcaaacgccaccgcccgggaggcgtggaaggtcatgcctgagctgatcgtgcagcatgccatcaattccctgttctccgagcgggtgggcatgaagccggagaacatcagcctgtccaccgtgccccccacggccactccagccccctgcgtctataccgacctgccctacgccgtggcgctgcgggacatctgcgggcgctacaagatgcgggcccagcagaacacgaagtacatctgctcctccacccgcgaggcgacagtgacccatgtgctgaacatgctcatttcaaagctgaccagcgcggacatccagtccaccatcacccctgacgagggccgcaacgtcccctggcacatctacaatatcgaggccatcgacaacgccaagcagaccctcatcggtctggacggcctgatggagatggtggagctcaaaaaggatggccctctgcgcgagatggcccgtgagctcaaggagcgcgcctgcctgttcatggaggagatcgtggaggtcggcggctacttcaacgctgttcaggagggcttcttcgtggactccgccaagtaccccgagcgcaacggcgacggcatcgcccgcaagattgagggcggcgtgggctacggctacatctttgagcgggccgaggactacatggcccccgtcactgcccactacggctacaacaacgtggagcagtacggcggcgatccagccaacccctccgccctgattggcggctgcacgtttgaggaccgcagcaagatcgtctacatcgacgagctggatgaggaggacaacgtaaacgtccgtctggacaaggtaaagaagtatctggacggagaggccatcaagcccgaggtggagtggtgcgccgacggcaccatcctgctgaccatgtgtatccccgctgagaagcgtgtggctgaggcggcggccctggagatcggcaagcggctgggtctggatcaccctgaggtgatcagcaaggaggttcttcaggaggcggagggtacccgcatcgagatgaagggcaagctgaccttcgacgtggatcccaccaagctggaggtcccccccgagccccaccatttgagtgacgccgtgctttacaaagagttcgaggagcaccccatggtggtggtctgcggcacggtaggcgaggatgagcactctgtgggcctgcgggagattatcaatatcaagcacggcggcattgaaaagtggggggtcaaggttcactacctgggcacctccgtcccggtggaaaagctggtggacgcggcggtggagctgaacgccaacgccattctggcctccaccatcatctcccacgataacgtccactacaagaatatgaagcgcatcaacgagctggcggtggaaaagggcatccgtgaccgggtgatcatcgccgccggcggcacccaggtcatcccggatgaggccgtcaagaccggcattgaccagggcttcggccgggattcccacgggatcgacgtggccaccttcctggcagaggaggccatgcgccggagaggtgagctgtaagctcaaagcaatccccgaacggctggattgctccatatctatccatgccccggcgaaggcctgaaggggagccggggcaggataggtttcaggttcgtctaaaatgcggtcaaatgaaatgaacggaccccaaccccattccccaacctgattttggatttaggaggagccttcatgagtcaagaaacgacgaacaaagcaggcggcgtttcctttatcggattgcttggcctggtcatcggcgcaacaatcgcaagtgcggtatttgcattcccgggcgactttgctgcggccggggccggttccggcgctgttctggtgggctggctgataaccggcatcggtatgctggggctctgcctggccttttattacttaaacaaactgaagcccgagctgaagggcggcgtttacagctatgcccgcgccggctttggttcttatgtgggatttaactccgcatggggttattggttaagtgagctgctctcaaacatctcgtttttgacacttctgttcgcctcggtaggacagttcctgcccctgttcggtgtaggaaacaacatcccgtcggtcattggcatgtccgtggtatggtggattgccattatcctggtgctccgcggcacaaaggaatccactgcggtcaacctggtttccaccatcgcaaaaattatccccattctggtgctgatcgtcgtcattatttttgcccgcgccttctccttcgagacctttatgcagaacttctcgggcagcgagggcggaatgagctttggcaagcaggtcatggcgaccaccaccaccacagtgtgggcgtttaccggcattgaaggagccgtggtaatctccggccgcgccaagcgttccagcgacgtgggccgcgccacggtgatcggtttcctttccgtgctgattctctacattatcatatccttcctgagcgccggcgtgatgaccaatgaggagctggccgctctgggcaatccccccatggccggtatcctggagcacgtggtgggcccctggggcgctgccctggtgaatatcgccgttattatctccctgctgggggccacgctgggccacaccatcatgtgcacagagtgcccatatgaggcggccaagagcggtgcgttctgcaaggcgtttacccgaaccaataaaaatggcgcgcctgtcttcgccattatcctcaccagcatcattgcgcaggtattcctggttctgctctatttcaatgaatcgacctatcaggtattttacttctttgccaccggcatgatcatggtgccgtacttcctcagcgcaatgtatttctgcaaggtggcgctgaagcaggagaacgggctgatcaaaggaattggtattttcaacgctgtttacgcggtctggatggtctttgccgccggcatcagcgtcatgctggcaaccgtcctgctttatgtgcccggtatctttgtctatgccaagggacaaaaggaaaagggactaaaagtattcgagacaaaggttgataaggccgtttttgtcgcccttctggcacttctggttatttgtatctactttgtggccaccggcaggatcaatccgctcggctgattcggctgaatgtcgtcctgtcccgcgcaacagcgcgccgaacgaaacaagtcgggcaaacaggcaaaccgaggggcagaggcgctgcggccttctgccctggtttgcctgtttgcaaagcaaatctgtagtatgtttgctgccttccaatgcagcagaaaggcggtgacagtaatgaaagtagatgtccttgtagcggagatcggctccaccacaacagtggtaaacgctttccacggcctggacggcgatcgtccggtctatctcggccaaggccaagcccccacttctgtactggacggagatgtacgtatcggcctgcagagcgcagtctccgacctgtgcggcaagctgggaacggagtccctggagtaccgcgagatgctggccacatcctctgccgccggcggcctcaagatgacggtacacggcctggtatacgacatgacggccaaggccgccagggaggcggccctgggcgcgggagggattctccactacgttacggcgggacggctgcgccggactgatttggccaagatcaaggaaatacgccccaacctcattctgatcgcaggcggcgtggactacggcgaacgggacacggcgatcgccaatgcggagatgatccgctccatgaacctgaaaatccccgtcgtctacgccggaaatgtggagaatcaggaggagatgcgcctgattttcccggaggaggagggggagcagctctacattgtggagaatgtctaccccaagatcgacgcgctgaacgtagagccctgccggaaggtcattcaggatgcgtttgaacaaaacatcacccatgctccaggcatggagcacgtccgggagatggtgacaggccccatcatccccacgccgggcgcggtgatggaatgtaccaagctgttgtatgaatacctgggcgacctcattgttttggacgtgggcggagcgacaacagatctgcattccgtcacggtggagtccgaccaggtggcccgcctcatgatttcacccgagccgaaggccaagcgcacagttgaaggggatctgggcgtgtatgtcaaccgctggaaggtggtggagtccatcggcgaggagaagctccgggagcagtgccgggagcagggcttttccatggagcatgccctggagacctatcgggccatccccaaaacggaggaagaagtgaagctggtggagctgcttacccgagaggccgtggtaaaggcggcggagcggcacgccggcaggctgcggtatatctacggcccctccggacgcagcacggtggccgagggcaaggatttgacgcaggtcaaatacatcgtgggcaccggaggcgccctcacccggctgccccaccgtgaggagatcatgcgggagatcacccgctgtaatgagtcgggcatgctgctgcttcccggggagcacgcccagatcctggtggatcacgactacattatggcctcgctgggcgtgctgtccaagcggtacccccaggcggccgcccggctgctggagcagagcctgggcatcacctttccggagcggaaagcggaggagccggtacccgtctgcaacaaggagctctcccggcttgagacccagcggcagcagcgggaagaggagctacagcggcacattgaggagtgcgaggccatgggctatgatatgagcgcctaccgggagaacaagccgaaagcaggggattgcagccatgagtgcagccgctgtacccgcctccactgccccaaccgcactacacaggaaggagcgagttcgtaagccatgtaccccagagtgcgtattcacatggacagactgcgccggaacctggacgcctgcgccggcataatccaaaaggttcccggctgcacccttatgatcgtgaccaagggcgtgtgcgcctatccccccatcgtccgcatgctcacggagcatccgggggttgattttctggccgactcccgcatccagaacctgaaatcctatgccgcacaggcgcgtcaggccggtaagcagacggttctgctccgcctgtccatgcccagcgaggtatccgaagtggtggagtatgcggatgtcagcttccagtcggagctgtccaccatccggctgctggacgaagccgccgggcgggcgggcaagcgccataatgtggtgctgatgatcgacctgggcgatctccgagagggaatcttttacgaaaaggaagaggagatcttttccacggtggcagagctccttttgctcaagcacatacgcctgtatgggcttggcaccaacctcacctgctacggggccatcattccgaagaatgagaatctctccctgctggtggggcttgcgcgaaagctggagcagcgcttccacatccggctccccatggtctccggcgggaattccagctccatttatctgattgaacaggggaatctgccggagggcatcaataatctgcgcctgggcgagtccttcctgctgggcaatgacactgcttatggcacaagaatcccgggaaccgtgggggacgcactggagctggaggcggaagtcattgaaatcaaggaaaagccctccctcccggtaggcgagatcggcgtggatgctttcggacaccggcccacctatgaggataaggggatcatgcgccgggccatcgtggcggtgggccggcaggatgtggacacagacagcctgcagcccagggatccgcagatagaaatcctgggcggaagctcggatcacctgctgctggatctgacccactgcaccactgtataccaagtgggggaccggatacagtttacccttggttacggcagcatgctcaaggcatttaccagcccctatgtggaaaaagtcatctgagccgcagatctctgcggagagggagtggcagatatgttacggaaactcgacctgatcggcgttcagtcggattggggtgcctcgcagcggggggccagcatgggaccagccgccatccggtttggagggcttgtggagggtctggagcggcagggccaccacgtacgggacaggggagatatcctcgctccccggacaggggccagccgggaaaagctgctgcactatgaacaggtgtcagaggtgaaccggcgggtgtacctctccgttacggaaaccctggaggaggggcgtttccccgttatcctgggcggcgaccacagtatcgccgccggcagcatcgcggcggtctcgaagaggcacagcggcaacatcggcgtcatctggatcgatgcccacggcgactggaacagcgaggagagcacatgcaccggcaatatgcacaggatgcccttttccgctgtctgtggttacggacctgactgtatggtggagttcggccagggagcggcgccggttaacgtggctcactgcgtgcaggtcggcggacgggacattgacgatttggagcggcagcgtatggcgcaagcgggggtcactgtgtttccgatcaatatgatcgacaagctcgggatgggcgcggtaattgagcaggccatccagatcgccggagagggcaccgatggcatccacctcagctttgatgtggatgccatcactccggaggctgtgccgggcacgggagtgattgtttacaacggcctgaccccccgtgaagcctttctggcggcagaggccattgcggagagcaggaagctgatctccatggacatggtggaggtcaatcccttcctggataccgccaataagagcggcattcttgcctctgagctgatccagtcggctctgggaaaaagcgtatattgagcacggagggagacctgtggaggaacctttggaacagaccatttccgcacgccagcttggggctgccttttcggggtgttttctgggggccggctatgtctccggcagggagatgtggcagtttttcggccggtttggcccggtgggctggctagggctgtgcctgagcatcgcgctgctgggtggggcggggctgcttctgcttaccatggtccggcggaccggccggcatgagttgtccttcctgatggtcccctggcaatgcccggcgctcagacatctcctgcctcttttctctgtcctgctcctgttcggggtggtaaccatcatgacagcggggacgggggcggcgcttcatcaggcctttggactgcccccctggctatgcggattgctctttgctctgctgatcgcagccctctctctgtcggggctgcgggggatgatctctatcttttcctttgcggcccccgcgctggttctctgtacggtggggttaggggcgggggccctgctcctgctgcctgtccgccgcctgcgttccagggcggtgttgggtggcttccctccgctatggcattttcggcctataacatgttcagcgctgtggcaatcctggcccccctggggcggcaggtcccgccaaggtgcactccaaggggaattggcctgggctgtaccatgcttttcatggtggccgcgccgattctgcttgtcctgaaccactatcccggggcggccgagacggaatttcccatgctgacggtggtcacagccatctccccaggactcggcattccctatcttttgctcctgctgatcgccatggtggtcaccgccttttcctgctttctggctggtatggagcggctctccgccggaacagagctgcacggccgggagagggtcctccggtttttcgctgtctccctggtggcctggggcgcgtctctgctgggcttcggtgaactcatcagtctgatctacccggtgttcggcgcagtcagtgcggttttcctaacaggtatggctgtccatttttgcagggtgaactgggggaatccgaatgaaaaagcagacggaaagtgacctagtggcagaggcggtcgcctacatgaggctccatttcgccagaccactcaaactgacaaaggttgcaaggcacgtgggctgctctcccgcctacttgagcaggaaatttcaggccgaacgctcctgcacgtttacttactgtctgaaccagatccgggtagaacagagcaagccgcttctcctcaaccctgccctcacggtaggggatgtgggctacctggtgggattttgtgagcagagttattttgttaaggtatttcgcagatataccggtatgacaccgaggcagtaccagcagtcggaaaagcggggtctttcgccctgaaaggagcgcagtacgatgtatttttgcagaccagggctggacacagcgctgcttcccggatcattcaaacagacgatcaggggggaaacgccggttggcgtttcccccctgtgttgctctccgcgcctctgcgtcatagtctaaggcagggccattgcgcccaatccagtatggagtgtacccttatgaactattatggatgttattacacaggaaggggctgcccctgctcctgtgatacctcagatgacgaactgtttcagcgcgggccgcagggcccccaggggatccccggtgagcggggtccgcagggcccacgtggtccaaagggcgatccaggctgtcctgggcctgtcgggccccgcggtatggccgggctgcccggcacccgcggaccgcagggcgtgcggggcgacgccgggccgaaaggagatccggggcccatgggtccccagggaatccgtggagttccaggtcctatgggcccgcaaggcgaccgcggtccggttggtccgaagggtgatcccggtccggccggccccatgggtccgaaaggggaacagggtgatcccggagcccgcggtccggttggtgaacaaggtcctatgggagaacagggtctacagggtgaaaccggcccacagggtcctcagggagagcgcggctgccccggtcctatgggggagcagggaccaatgggaccaaccggccctgccggagaagtcggccccaccggcccccaagggttgaccggtcttaccgggccgaccgggccgattggacctcagggcatccagggtgtcaccgggccgaccggacctcagggcagccagggcgtcaccgggccgaccggacctcagggcagccagggcgtcaccgggccgaccggacctcagggtatccagggcgtcaccgggccgaccggacctcagggcatccagggcgtcaccgggccgaccggaccccagggcagccagggtgtcaccgggccgaccggacctcagggcagccagggcgtcaccgggccgaccggaaccaccccatccgtcacggtgcggaatgtaacctcgggctctaccgccgctgtcaccgccaccccctccgacaccggcgtggcgctggactttgtgctgccccaggggccaaccggaccgacgggaagtaccggcgtcaagggtgacatcggcgctaccggccccgcgcccaccatcacggtggaggagagttcccccaccgcttaccgtgtgcgcttccacggcagcggggccgacgtggtttcccccaacctccgcgcgagccccgaagtctataacatgaatttgtcatctacggggagcgccagggaaatcaccctgggcaaactgattctcaatgtgcagaacgccggtaccagcgccattcgtctgagcctccgggcagcggacactgcggcccccgtactggtggacctccggcgaaccacaatctacgacgggagcaccattgaatctcagacctggaacagcgtatccttttccactgctcagataatcgacgatattctctacgacaactcccaggaaactcactggatgcggctccgccagcaggaccccgccaccaagctctggtccatgtgccagatcactacctttgcctcggcggcaggcgcccgcgtttcggtcatcatcgactggtattacaccggcgtaacctttgccgccccatccggctcctaaaaaggaaacaggcgcacgccctcattctgggcgtgcgcctggatttttgcgggcagctgctaccctggcctcttaaccgccgactccgttctccagctccaccgtggccagatgcaggtcgaagaactccgagaggtcgcttgtaccctccagcacaaaggcgtcgggggacagctcccggccgctccagtcctcctcaaaggccagggccaccgccaccggatcccgcagctcgggccgctctccggcatcgcaggcctcctggagggcggcgtaatagtcgtccatgggctggtcggcctccggcaccaccagatagcgcgtgccgttctgatccacacagcggtctacgcaccagatcccctcctccccctgggttgcgggctgggagagcaccagggtgtagaccgtgtccgccgcctcttcatagccggacaggccgtaatagggatagtagagcaccgtcacatgctccccgccgggataggagagggggccggtgacccgctggtagaagggatcctcctccataggggtgagtccggccccggcggccagttcctccagccacgccattagggctgtccctgtagcatggtagtcgtcgtagtggtcgagattgaagttcacatcggtgggggcgtggcaggcgtagtaccagtccccgttccagcccaggtaggcccagttgccggtcagctcccagctgtaataggactgctcaaagcccacctggctgtagcgccccacctggaggagcagtccaccccattcggtgttgtagtccggcgcgtaataataggtagccaggatgccggagctataggacttgaggtcgtttttctccaccaccacgaccttgtccgccagctccgccggcagggcggccagcccgctctccaggggaaccttctcctccgtctgaacagccaggttggacacgaactgccagccctccccgcgctcccgcagggtgacctgcttatatccgtcgcccataaaggtgtcgtcgtaggcgaggcgcaccagctcgccacgccgctccccgccggtgaaggtgacggagccgcggtaattggtgtcgccgtggtagtagaaatacacatcgaagtcgggcagataggtaaagtgttccagccccacctggccggtctccgccagggtgaggcccagatactcctccaacaccttatccatctgggcggtggtcaggatggtggccgggcagtcggggtcatcgccgccctcggcggccagcatggccgcctccagggccaccgggtcgacgccgtccggcggggcggcgtagtcggcgtccccgtcgccgcagtagaagagctggaacaggtcgatctcctccggcgcggcataggtggagctgaggaactggttgcggatgttgatgccgtccgttccattgaagaacgcatccccgttgaagtaggccagctcctcctccgagagcggctcccaggcgtcgctccgcccgccggtgaaggtgcaccccaccgccagccccgccaggaggaccaccgccgccaggacggcggccagggttctgggcttccttgcaatcatggcaatccgctcctttaagctcgatgttccggcggtcatagtggtggcgcagcacagcagctcgcccaccgacggccgggccgtcaccagccggatcagagtacggccgtaggccgcccgctcccggtcgtccgccccctggagggccccctcgtcgcaggccagctccccgtcccgcctggacaaaacggcggccagccagaccaggggattgtaccagtggagggccagggccgccgcccgcagcaccgcccagatgtggtcgccgtggcggcggtgggtcagctcatggcgcaggacgtggcccagcagctccggttcgccggccgccgccggggtcagatagaccgcgggccgcgggaagccgtacaggcagggggagggcagcccgcgggccacgtagaccggtacggctatccccgggatggggtgggtccgccgcatccgccgcaggcgcagataaaagcgcaggttgcacgccagcagggcggcggccagcacccccgcgccgcccagccacaccgcggtcagaacgcccctccagtccgccgccccggcgggcgcggagtccggcgcggccgccgggccggagggccggggttccgcctccccctccggccggacgggcatgggctccgcctccggggcggagggactcccgccggactgggacggctgggcttgtgccgcagccgtctggggcaggggcacatagttcagcacgctcaatccggtctggaacaccgtgcccggcaccagaaggcgcaggagcaccagcagccacagggcgtaccgcagccgcaggcccatccgcccccggaacagggcccgcacggccagcacaatcacgatcagcagggacgatgtcagaatccactcagccatgctccttctcctccagtcccttcaaaacgtcgtagagggcgtcgatctcctcccggctcaggcgctccggctccgccgcggcgtttgtgagcatgctcacgctctcccggcagatacgccggaggaagctgcgggtctcgctcaccaccgcggcccggcgctccaccgccggggcgtaccacttggcccgctccccctgccggcaggtgagcaaccccttttcggtcatccgcttgagcacggtggtggtggtgcccttggcccacccctcacgcccggccagggtgtgggccagttgggtcatggtctggggggacgcctcccagaggcagtccagcaccgcccactcggttcccgtcaggcgcaccagttctccgtccatttcatcacctccatctggtagacatcgtctacctataacatagcacagcaggtagacaatgtcaaccttttatttttccacctcctgctctataatagtgaaaaaaggaggctttgccatgcagacaaccgacaagctgatggaatatattcaggacagccccagcccctatcacgcggcggccgctgcagccgcccggctggaggcggcgggctttacccgcctggaggagagcgccccctgggcgctctcccccggccagtgctgctacaccacccgcaaccagagcagcctgatcgccttccgcctgcccggcggcaccccggagggctggcgcatgaccgccgcccacagcgactcgcccaccttctatgtgaaaaacgacgcgctggagggggacaagcgctacgtccgcctggcggtggagggatacggcggcatgaactgcgccagctggctggaccggcccctcaccgtggcgggccgggcggtggtgcgcaccccggcgggggtggaggggcggctggtctatctggaccgggatctgctcaccatccccagcctggccatccaccagcagcgggacgtgaaccggggccacgactacaacgcccagaaggacatgcagcccctctacgccctgggcggcggcccctccctcaccgccctgctggcggaggagctgggggtggacgcgggggacatcctggccaccgatctggtgctctgcccccggcaggcgccggtgcgcatcgggccggagggtgaattcttccaggccccccgcattgacgatctgggctgcgcctacgccaccctggaggggttcctcagcgcgaagggcacggagcgcttcgggcagctctactgcctcttcgacaacgaggaggtgggcagcggcacccgccagggggccatgagctccttcctccccgacgtgctcacccgcatcggggaggcgctgggcctctccgcccaggcccgccgccaggccctggcgggcagcctgctcctctccgccgacaacggccacgccgtccaccccaacttccccgagaaggccgatccggccaacagggtctaccccaacggcggcgtggtgatcaagtactcggccaaccagaaatacaccaccaccggcctcaccgccggcctgttccaggccatctgccaaaaggccggggtgccggtgcaggtgtttgccaaccgggccgacgagccgggcggctccaccctgggcaacctgctgggccaccaggtcagcatccccatggtggacatcggcatggcccagcttgccatgcactccgccgtggagacggcgggcagccgggatccggagtacatggcccgggcctgcgccgccttcttccaggcggagtttacccagaccgccgacggcgtgtatcaattctgatttcaactgtcctcaccggaaaaggccggcccgtcgtgagacgggccggcctcagcctgtcgaaacctcttttcgacaggctgctgaactttttgagactctaaacgagttccaaaaagttgtttgatcccacgcgaaagggaaccctgacggttccctttcacactatccttcccttcgaaaaccttagcaggaaggcttattaaccgcctaaaggccggcccgtctcacgacgggccggcctcagcctgtcgaaaccttttttcgacaggctgctgaactttttgaaactctaaacgagtttcaaaaagttgtttgatcccacgcgaaagggaaccctgacggttccctttcacactatccttcccttcgaaaaccttagagggaaggcttaataaccgcctaaaggccggcccgtctcacgacgggccggccttttccattaagggcttccgctctgcaaagtgggcgcgaatatggtcgaacaactgtgcggcggcaaaggagtgatagccctgtctcctgcggatgatggcaatatcccacacgatgcgcggctccaggggcacggtgacaagcttgtcgcacatcccgtggaggatcagcggcaggggcagcaaggcgatgcactgctgcatggccaccatcttgaaactgaagccaggcatcaggcttttataggcaatgcggggggcaaagccctgctcgccgcacatctgaataaaggtgtcgtgcagggtggccgtttcactgaaggtcagaatggtctcccctctcagctcacggatatgtacgccgggcatctgggcaaagggatgctcccggctcaccacaagctgacacacatcgctgaccagaaggtggctttcaaagcgggacggctcctccaccgggagcatgaccagtcccagatccgcctttcccaatcccaccgaggcggcggtgagcttggagccctcctccaccagactgatgtcgatgccggggtattgccggtgaaagctggcaaacagctcgggaaaatacatgtccagcagcaccccgggaatactcagccgtacctctccggtcttgaccgagcgcacgtccgccatgatctggaagatcgcctcatactgcatgagaaactcctgggcccgctcgtacaggatccgtcccgcatcggtcaggtgaaagctcttgctggtgcgttcaatgagcagaacattcagcgattcctccagttgtttgatggaacgggtcagcatgggctgtgtcacaaaaagctgggcggctgcgcgggtaaagctctcctgccggaccacttcaacaaaatatttcaagtgctgaatatccatagctacctccacgtcctcggtgatgctgtccctatcataatcgaagaataaaaaaatttccagaaaaagccgcacaaagtttctagtgtgaaattgttaaaaatgaagcacagcattccccccgcgcattcgtccatacgcaaaaggcatgatactgtggatatgccacaaatatagcaataaaagttctacaataatgtgcaatctattccgattttggaatgcagcctatcaaattgttcattttacagatgtacttcctatgccgtatactttctgcaacggcgcgggccgcagaccagccgaacccgtgccgcctccttccggggaggaatggtgagcggaaagggagtgcagatatgcccaaaatcctgtcggcgcacgatgccgtgcgccagtacatccacgacggagacaccgtcaccttcggcggcttcgccagcggcctgatgcatccggagtccattctcagagcgctggaggagcgggcgcgaaacggcgaggggccccacggcctgaccgccttgtacgccgccggtcagggcgacagcgacagccgcggcctgaaccacctgggggtggagggcctttgccgcagggtgatcggcggccactgggggctctcccccaagctgggccggctgtgcgcggaaaacaagctggccggctacaacctgccccagggggtgatcgcccagcttttccgggacattgccgcgggaaagcccggcgtaattacccatgtgggcctgggcacctttgtagacccccgcctggaggggggcaagctcaacgacgccgcccgggcggccggggacgtggtaaagctcattgagctggagggggaggaaaagctgttctaccctgccatccccattcaggtggctattctccgggccagctatgccgataccaggggcaactgcaccttccagcgggagggcgtatacgccgaggccctagcccaggcacaggccgcccggaattccggcggaacggtcatcgtccaggtggagcgcattgtggaatacggctccctggacacccgcctggtgcgcctgcccggcatctacgtggacgtgctggtggaggccccgccggaggaacatatgcagaccttcggcacccgttataacccggccttctccggcgaggtgcgcgtgcctctgcactccctgcccccgctgcccatgggagagcggaaaatcatcgcccgccgggccgccatggagctgctcccccacgcagtcaccaacctgggcatcggcatgccggagggggtggccgccgtggcggcggaggagggcctggaggggcttgtgctgaccaccgaggtaggggccatcggcggcatccccgccggcggcaaggacttcggcgcagccatcaacgccgactgcattctggaccagcccgcccagttcgatttctatgacggcggcgggctggacgtggccttcctgggcctggcccagatggacgccgcaggaaacatcaatgtctccaaattcggccccaagatcgccggctgcggcggcttcatcaacatcacccagaacgccaaacgagtggtgtactgcggcaccttcaccgccggcgggctggacgtggcggtggaggacggcaggctggccatccgccgcgaggggtccgtgcgcaagctgctgcgccaggtggagcagatcaccttctccggcgcctatgcggccaaacggggccagcacgtgctctacgtcacggagcgggccgtcttcgccctcactccggagggggtggagctgaaagagatcgcccccggcgtggacctacagcgggatattctggaccagatggacttccagcccatcatccgcaaggtccgggcgatggatccccgcatcttccgcccggaacctatggggctcaccctgccttgatctgagaggggacgtttattctgtatctgtagaggaggaatccaaatgtcactatccctgttcggcattattttgggcctggtcctgctgatgttcctggcctacaagggctattccatcatctgggtcgcccctgtctgcgccgtggtggtggccgtgctcagcggctatgccatcctggacgcctacattggcgactatatgaagggcatggccgactacgtgctccaatggttccccgccttcttcctgggggcggtgtacggcaaggtcatggatctgaccggctccgcccgcagcctgggcaacgccctggtcaagctgatcggcccccgcttcgcggtggcagcagtggttatcccctgcctgctgatgacctatggcggcatctccctgttcgtcgtggtgttcgtcatctatcccatgggctattccatctaccgggccgccgacctgccccgcacccttctgcccggcgccattgccaccggcgccttcggcatcaccatgaccgccgtgcccggcaccccccagattcagaacctgatccccaccgactactacggcaccaccaccatggcggctccgctcctgtcccttgtggcctgcgccgttatgctgctgcccgcctatatctacctggagtggcgggtgcgccagtcccgccgcaagggcctgcactttgtccccgaccccaagcacaaggaagtggatcacgactccaaggctctgccctcctggcactgggtcaccggcatcgtccccctggtggtggttgtgctcatgctcaacctgttcccctggctgctcaatcgctttgccggcattgagctggcctccaactacgccatcgtcatcgccctggtgtgcggcattctggtggcctgcctgctgaacctgaaccaggccaagaccctgctgcccgccatcaacgagggcgccaacggctctatgggcgccatcatgaacaccgcctgcgccgttggcttcggctccgtggtcaaggtggtccccggctttgcctccctcaccagcatcgccctgaacatgcccggctccatcctcttctccgaggcggtggccgtcaatctgctggccggcgccaccggctcggcctccggcggcatgtccatcgccctgtccgccctggggcccaagtacgccgaaatggctgcgggcaacaccggcgttctggaggccctgcaccgcatcgcctccatctcctccggcggcctggacaccctgccccacaacggcgcggtgctcaccctgctggccgtgtccaactgtacccacaaggagtcctacatcgacatctgtatcacgacctgtatcattccgctggtatcctctctggggctggccctgatctggggcctgttcctctgatccccgtcagcgcatacaagaaggaggccgcatcatgaccattcagcaattgaagctgggcgacagcgccagccactccaagaccatcagcgagaccgacgtgtaccttttcgccggtatcaccggcgatctgaaccccgcccatgtcaacgagtccgtggccagcgcctcccggttcggcggacggattgcccacggcatcctcagcgccggcctcatttccgccgtcctggccatgcagctgcccggccccggcaccatctacctgggccaggagctgaagttcaccaggcccgtccgcttcggggacaccgtcaccgccacctgcacagtgagcgaaatccgcgcggagaagaacatcgttaagctggatacggtgtgcaccaaccaggcgggcgaggtggttttacagggcatggccacggtcatgccgccccaacagtagcgttttcttcccatacctcccctttctcatgcagagcccccggatgccattggcgtccgggggctctgcgcgctcacaggggcaggcggaggacggccaggacgccccgcgccgcccggtgcagctccagtgcgccgccatgggccctggcgatctgctccaccagcctgaggccggtgccgtgggcggccccgccgtccggggccagtccgaccggcagaccaccacccccgtcgtcctccaccctcagggtgcatacttccccctcggctgccgcagtcagggtgatggcgcagccctccgggttgtggcgcacgcagttgttcaccaggttaagcagggcccgccgcagcagggacgcgtccccctccaacgtaagggtttcggcctccggcggcacctccaccgccagggcgtaccgctcctccagcccgccgttgagcacgtcggccgccacctgccgcaccagggcggcggggtggaggctcccccaccgcaggggctgcatggcgtagtccaggcgcatggtcaggttgaggtcattgatcagatcccggatggtctggctctggcggcggatgatggcggcctgggccctccgccggggcgggaggaccgggtccgcctccaactgcccggcgtagcccatgaccatggacagaggggtgcggatgtcatgggagatgccgttgatccagtcggagcgggcaaagtcccgctcctgctgttcccgccggaactggcggcccagcaccagggcggtgaggcccagcacccccagcagggccagcagaaacagccccgcgaaccagaaagggatggtcttcagcacatccatatccaagacgaaggggtgcttccaggtgctccccttcgggccgcccgccaccagcagaccgtcctcccgtacccgtacctgtaccgggtagtcgctcagataccagcgggtaaaggcggccacatcggtaagggagtagcggtcgggcacatcggcgggtttgccctgctgccacaccacggcgccgccctcgtccaccagcatggcccacagctccttctccgccaggtactccccgccggtaaaggcatagcccccctccgtccgcaccagggcggcggagagctcgtccatggaggcgttccacgagctgcccgccccggcagaggtgacaataaaggccagcagccccgccaccgccagaaccagcaccagcaccgccgaggccgccaccaggccggccgccaccagggtacggcggagattgcgccccctcacggccgctcctcctgggccaggcggtagcccagcccccggacggtgagcaggtactgcgggtgggaggggtcggtctccagcttctcccgcaggcggcgtatatgaaccatgagggtgttctcatagcccaccatgggcccctcccacagggcctggcacagggcgtcgatggtgacgatgtttccccggttggccgccagctttttgagcagggcgtactccttggcggtgagggcagcctcaccgccgccggggcggcgcaccgtgccggtgccccagtgcacctccgctgccccgaggcgcagcacctcccccgccccagcgccgtacacccggcggagcaccgccgccaggcgcagcagcagctcctgaggcaggaagggcttggtgatgtagtcgtccgcccccaggcccagcccccgcaggcgagcctcatcctcgtcccgtgcggagaggaacagcaccggcacgcagttctccacccgccgcagctcctccagcagggaaaacccgtccccatcggggagcatcacgtccagcagcgccgcgtcgggctgcgactctgtccacgcccggcgggcctgggcgcagtcggctgccagggtgacggcatagcccgccccctccagcagctctcccaccatgcgccgcagctccggcgcgtcgtccaccagtaaaatgtgataggccatccttgcttcccagtcctttctgatcggagcaaatgccccgtagggacgaccctcgtggtcgcccgcgggcggccagaagggccgcccctgccgacttgcgcagggcagaaagcacatggccccgcgccctgttcccgctgtttttctattatacaacaactggcttcccctttgcacgccccggccggaaaacgtaaggtaagcgtaaggatggcttcatcgggatgtaagggaggggcgctatccttgcggtgtaacaaggaggtgtcctcacatgaacgctgttgtggaaacccgcgggctgtgcaaacagtacggcccggctctgcgggtcaaccatctggatctcaccgtgccggagggggcggtctatggatttctgggccccaacggggcgggcaaatccaccaccctcaagctgcttctggggctggccaggcccacggcaggggagatcgccgtctttgggcggcccatgggtccccgcacccgcatggagactctcagtcaggtgggcagcctgatcgagagccccagctactacggccacctgaccggcgcggagaacctgcacatcgtccaaaccctgcgcggggcgccggagcgggacatcggggaggtgctgcgcatcgtccggctggacggccagaagggcaagcggacggcccactactccctgggcatgaagcagcggctgggcctggccgccgccctgctgggcttccccaggctgctgatcctggacgagcccaccaacggcctggatccggcgggcatccaggagatgcgggagctcatccgctccctgcccggccggttcggcatgacggtggtggtgtccagccacctgctcagcgagatcgaccagatggccgaccacgtgggcatcatccgggaggggaggctggtgtttcaggacaccctgtccgcgctccacgcccgcagttgcccccgcctggccctgcgcaccaccgacaacgccggggcggcccgcctgctgggggagaaccgtgtcccctgcaccctggaggacggctggctcacccttcccctgctctccgacgccgatgcagccagtctctcccgctttctggcctcccaccgggtggatcttctgcgcatggaggagcggcagaagagcctggaagacctctttctggagctcaccggaagggaggagagcctgtgaagctgctggccctggagttctgcaagtgccgccggcgcaagctcaccctggtctgcgccggcctgctggccgcccagctcctgtggttcggggtctacctgacccggcaggatgcggaggcgctggctcaggggtggatgcttctgctctacaacctggcaatggtggacgccattatgctccctatcggcgtggcggtgattgccagccggagctgtgagctggagcacagggggcataccctcaagctgctggagactgccgtcacccccggtcgtctctacgccgccaagctggcctggggcgccctggtgctggccggcctgctcctggtgcgcggcgccctctttctggccctgggccttgccatgggcttccccggcgggacgccctgggggcggttcgtggtttttaccgccctgtcctgggcggtgtccatgaccctctacgccctccagcaggggctgtccctccgcttcgccaaccaggccgtggctctggtatgcggcatcttcggcagcttcgtgggactcatggccctgctcttccccgtgtgggtacagcggtgcgtcccctgggggtattacggcctgctctctctggtgcggatggaatgggatgaggccacccgctggaccgctttcttttggcggcggccggagcccctggatctggccctcctgtgcctgtgggcggccctctttctcactgtgggacggactctgttcgtccgaaaggaggtatgaggcatggtactgcgctgtctccgggcggagctgatgaagtgccgccgcgccccggtgtggctggccttcctggtgctccccctctttcccgcggtgctgggcaccttcaactacctgggcaacctggaggtgctggacgccggctggtacagcctgtggacccagcacaccctgtttgcctccatgttcttcctccccgcccagttcggcgtgttctgcgcctggcagtggcggctggagcacgccgaccacaactggaacgctgccctcaccgccccggtgccagtgcgtgcgctctacctgggcaagctgctgctggacgtgggggtgtccgccctggccatggccctcatcggcctgctctttctcctcagcggcaggctggcaggtatctccgcccccctgcccccggagctgcccggctggctggccttcggcgccctgggctgtacggcggtgtgcgccgtacagctctacctcagtctggccatccgcgccttcgccccgccggtagccatcgccctggtgggtggaatcttcggcctgctccttaccagccagggcttcggcgccgcctttccctactccctgctctgcctgggtatgcgggccaacaacccccagatggccctgcccctcccctcctttctggcgggctgcgggttctaccttctgctcttctctctgctggccgtacggcggctctcccgccgggatgccgccaccgggtaaaacatacccccgcgtgccatagcacgcgggggtatgttttaccgcctatcgaaaaggtcctttcgacggcaggagggtttatagacatcctcctgtgtcatccgattcagtcctccctggaacagatgacggcagtcgccttcatggaggggatgaagacgatggcggcggtgatgtaggccaccacaaagatggcgggcaccttggtgatccagaagccgaagaagcccgcgcccatggcgaagccgatctcgcagaacatcagcaggaagctcatgagcaacacaatcacgaacacgatggccagcaggcgcaggaagtaggcggcggggccttccatcttcttgacgcccaaggcgcggacgaacttgttgcccatggcgggcagatcgatgatggtctccagggtcatgttgaggcagaagccctgaatcataccgatgataaagctctccggggtgagcgcgccctcgccggccttgacgaagatggtcaccaccaaagtgatgaagaaggccaggaaaatgttaaataccagagggaatttgctcttcttgcacatgacggctcctccttaccagttgtccttgttctcggcgtagacctgaggcaggatggcggccaggtggccgaactccttcaggttgtgggcgaacaggcccatgggtacctcctccgggacggacacgccgtcgggcaccagcttgaccagcctgccgtccaccaggccgtagccgatccagaagcgggagcgcagctcgatgccgccggggatctcgcggacgaagtgggtcatgatggccgccacgccctggccggggacggggccgtggccgttggcgcagatgagggcggcgcaggcgtcggtgcccaccttctcctcctcatagcccagctcgtggggatagcggaactccaaaaccagctcgtcggggccggggccgatatcctccagcacatggtggacggtgccccaggtgcgctcccgcatgggcaggctctggtccagggtcttctcccgcatctgctggcgggcatagtagtgatcctccgggtcccagatgcggtagcggagatcctccaggctgtgccaggcgaaccaccactcgaacatctcaggagtcacgccgggcatctcggtgcggttggccaggaagccggtgccgttgggcatgacgcagtagccgatctcgcagggcagatagccgggcttgaacaggtcgttgcggtcctcgatcttcagcgccaggctgggatcgatggggccagccgccagcacggccagcttctcctccggaatgggggtgataggcaggtcgtaaaacttagcgtagggcagggcgcgctcagcagcggtcagttcgggtctcttgctcatgataaacactccttctgtgttttgtattcacgtctattttcataagcaatccccgtgccaaatgcgccgcacggcccggaacccccgccccacaggggacttccgccctccttctccccccattccgcccctcccttctaccctttggactgatttggggtataataaacttccctccgtcaaaataacggagggaagtctttttgtctggaaatagaacgacaaactgcaatttgtaaactaatcaatacaaatcacctttgcagatttatcattcactataattgcctgatgattgttaattgggcaaatattcaaatccgaaaactcagctaatatcttttcagtaactttcttaaatggtgcagtaagataatgtgggaggacataaaaatcaacaaaattaaggcccttatcatcttcttgtgaataatcttctggtttcttatccatttgttcaatatatgtaattgttgaagaacatataattgctccagccgactcaccaatcattagttttccattcataacttctttcttcagcaactcatcaattcccgattttcgtaattggtcaataagaaaaaatgaattaccaccagtaaaataaataacatccgattcttcaaaaacagattttattgttgaatattcctcctttgaaatatcaatttctgttaatattgcccctatttttttaaataatttcctagcggaattcacataacctgtatagccttcgtgaattgaagctgtcggaataaatacaaccttcttattttcaacatcttcttttatcagattccctacacttgaaaagtgtgaacataaaaacaatttcatccgtaatctcctttataaattctgatttatctgtttgtctaccttatcatattttttagtttttttcaatgtatagtgaaattgccggagttgaaacccatcagtccaaaagtaaaaagggagttccgcccggctgtcttgtcttttttccgtacatattgtataatagtgttcagattatgaacaggtggtgaggacatgcagactctgcacatcagccgccaggagctgcacacccggggcggcgtcctggaccggatgctggacagcctgttcgacaccgccattctggtggacaccgactgccgcatcctctacatcagcgccagctccttccccgacccgtcccagcgggcagcggtggtggggcagcatatctcagtgctggaccagctctcccccttcgaggaggtgttgcgcaccggccaaccccggcccgatctctttctggagctccatggccggccctgtatctccagcctgtttcccgtcctggacggggagcgggtcatcggcgtggtgggcaccatcacggtgcgcaacctgggccggttgaaaaaggtgctctcccagctcagcgaccaggccgccggcttccggggcctctaccaggatctggcccgggtggacagcggctaccgcctggaggattttgtaggggagagcccccgggtggccgacctgctggacaaggcccgggaggccgctcacagcggtgagagcgtactcattctgggggagaccggcaccggcaaggagatcatcgccagcggcatccatgccgagcgccacgggggccgccccctcccctatgtgaccatcaactgtaccgccatcccagagcagctcctggaatccgaactcttcggccacgagaagggggctttcaccggcgccaccgaggcccggatgggcaagtttcaactggcgggggacggggatatcctgctggacgagatcggggacatggatctgcagatgcagtccaagctgctgcgggtgctggagtcccgggagtttgagcgggtgggcggtcgtgagatcatccccctgcgtgcggggatcatcgcctcgaccaaccaaaacctgctggccatgagcgagcggcgggctttccgggcggatctctactaccgcctgtccaccatcgaactctacctgccgcccctgcgggcccggccggaggacattcccctgctcatcgaccgcctctgcgcccaaaagggcgggcggctccgcctcacctcccaggccatggagtaccttcagcggtacacctggccgggtaacgtccgccagctcaagaatctggtgggccgctggctggtgttctacgacggggtgcagatcaccggacggcacgtggtggacgagctgaccatcggccagcgcagctacaacgaggccttcggcgtcaccgcccccctggcggggacggcgtcgccgtccggccccgcctccgcgccgccccccaccctggccgaccaggagcgcgccgccctggagcaggccctggcctatgccgggggcaaccgggcgctggccgcccgggtgctgggcatctcccgcaccgccctctatcagaagctggagcgtttccgcctgtcctgaattaaaacgcgggccgcgtatctcttggatacgcggcccgcgttttgcatgctatctggtctgctccccttcggggatcatgccgaagttttggaagggcagcaggacgcacaccgcccgccccagcacataccgctcgtccacggtgcccagggtcacgtcccggctgtcactggagtggttgcggttgtcgcccatgacgaagatggagccctccggcacctcaatatgggtctggttctcataggtgggacacagcatggcctcatggatgtagggctcgtccagcacctgtccgtccactgcgacggtgcccgcgtcgtagtcgatgtccaccgtctgtccgcccacggcgatgacccgcttgacgatgggcccgtccacatcgcggaaggccttggtgagcaccaccacatccccctgcttgggctcatagccgacgctctggagcagcagcatgtccccgtggtgcagcgtgggatacatggagctgccgtccacgccgatgatgcgccccacgaaggtgaagagaaggatcagcgccaccagagccagcaccagggcctggagccagaagtagagatccagcttgagggagtcgccgctggagagctcctcctgctcctccccgtcttgtgtttgcttctttgccaaaggtatcagctccatccgaatgggaaaaaagatcgttctattataccccgccctgctcacgattgcaagcgcagaacggcggccccctcccggccctccgccagccgcgcctcccggctgtggcaggtgaacaggaggatctgccgctcctctcccagccgggccagggcctccagggccagggcgcagcggccgtcatcgaagttggccagggcgtcgtccagcaccaggggacagggctcctccgcagggagcaccagctcacacaccgccagacgcaccgccaggtagagctggtcggcggtgccctgggagagggtcagcgcccgccggggctggaggccgtcgtgctcctccgccagggcctcaaactgctgggtaagggccaccttgtcgtatttcccgccggtgagctccgccagcagctcccccgcccggcggttgagggccggggagaaccgggcctggagcccgctgtgggcctgctccagggcggccagggccgctcccagggcgtcgtactccgcccggcggcagtccagctcctcctggatggcctcccgccgggtctgaagggcctcccggtcgcccagggtattcagctccccctgggccatggccaggccgctgcgcagccgggagagctctccctccgccgcgctcaggcgggccgcggtctcggcagggtcaaagcggggctccacgtccgtcccgccggagacctcctcgggccggggcaggctgtcggccagggttctggccccctccagctttacccgggcggtggacaggcgctcgtctaggttcagcgcccgggagagggcggcggatacgccgaaggtatccgtcaccgtgggggcgaaggggtgcaccagctccagcagcctccggcgggtctcctcgtcccgggcgatgtgcccggccagggcctgctccaccgcctcccgctttttggccgcctccgccgccaccacacacgcctcccggtaggcgctggcccggcccagaatatcctcgggccgctccgccccgtagcgtgccagcagctctgccgctccggcggcaaatcgtcttttccacagcccggcggcgatcagcagagctgcgcccccgatagccagagcagcggacaccccggccgtcgtcaaaacggccggaagactcccccccaggggcaggggcagcgtcccgcagaggggggctatgagccccaccgcgccaactgccagcagcaggattccgcccgcgtacagccccgctgttttgggtcggccgcccgccgcctccgcgtcggcgccggcccgctcccaggcctcgtcgggggtcaggccggggaacagggggtcctctgcggaggcccgggcctccgcctccgccgcccgggcctcctccagctggctctccgccagcttgcggttggcgtggagggtattgagggcgttgagctcctcctgggcccttttcagggtatcccggtcgggaggcgcgccgtggcgggtgcgctcggcctccaggccgtccacctgggcctgggcctcggccagagcggcctgggccgcctcccaccgggcccttcgctgggccatggcccggctgaggtgggcatcccgctcggactccagaagcctgtgctcggcctggagccgctccagctcccgcctggcctcctgggccagacggaaggccttggactggcgggccagggtctcctccacgtcggccagctcctcctccagccgggggatcaggccggtcttgttgtgcttccggcggttgagccagtcccgcaggcggcgctctacctgggagtaggacacatcctcctccccgctggaggccagggcggcgatgcgggcctccagggcgggggcgccgtcgatggccgcgcccccctggcccacgaaggcggagcgctcgaatacctcccggggcacgccggtgagggtctcccccgcgttgtccccggtgaggccgggcaccagctccgccgtgccggtatacaccgcctcaaagcggccaaagggggtgctccccttgggcccccggcggagggtgacggaccgcccctgccagagcagctccacgctcccctccatggccgcgccgctccagggctggtagcggttcttctccgcaaggtagccctgacggtcccgctccttggtgttgatcccgtagagcatggcccgcaggaaggccgaccaggtggacttgcccccctcgttgggggcctcaatgacattcagcccctcccccagcgccagctccgcgctctggagcttgccgaaggtggcgcgcatcttcaaaatcttcataggcagggatcctccccattctccagggccgccagcccgaagcgggcggccagctccagcccgtccccctccagcgccccgctccgcagggtgcgcaggaagaggccggtgaggctgtcctcccccgaccgggcccacagcgcccgccgctcccgggtctgatcccggagggtcacgctgtaaaagcggggctcggccagggcggcgagggcggccagctccggcggctcctccccccgctctccggtgagcacgatgcgacagcagtcctccccggcgtccgcgggcagggccgccgccagggcggcggccgggctctccgccccggtcacgtccacggtcaggatctcatagcgccgccgggccagggggacgaactcggcggacacggccccgccgtcgtccaccgtcaccaccagcacgcccttgtcgcccagctcgtcaaagccccggccctcgggacagccggggtaggcccagtacgtgtcccccgccttttgcagcccggagcaggcgtggatgtgtcccagggccaagtaggtcaggccgctggcggcgatgtcctccagggcgatgggaccgtagcgccccttcccctccacgtccccatggagggccatcaggtggatgcgcccgtcccggggggcggcaaagcccatcaggggagagcggtcggcctggggggtggtgaaggccgcgccgtgcaccacgcagttgaggccgggcagctccaccccctccaccgccacggtggaaaagatatgtacgttgtccggccacgccgtgccggcgtacaccgaacgggggccgtagcagtcatggttgcccggggcgatgaacaccggggcggggatgccccccagggtccgggccagggcctgtacggtctcctggtaggtctggccgccgtccagcaggtctccggagagcagcaccacgtccgcccgccgctcctccgccagcccggccagccggtccagcagctcccgctgctcggcccggcgggccctggccttgtccgggggcagggcggcaaacggggcgtccaggtggaaatccgccccgtggatgattgtcagcatagatgtctcggttcctttctcgcaggggatattacgcgcggatgtccacccgctcgacgctcacgcaccgccgctggtcggtgtcgatggagaagagtacgctctccagcttacaggggcccggggcgggctcaaagcggcggggcagcccgcccagaaagcggttgacggcctgctccggccggatgcccagcacgctctcggccgggccggtcatacccaggtcggtgacaaagcccagccccttggggagaatttgcccgtcggcggtggggacatgggtgtgggtgccccacacggcctgagcccggccgtccaggtaataccccatggcccccttctcgctggtggcctcggcgtggaagtccaccagcaccacatcggtcccctccatccgcctgagcacccggtcggcggtggtgaaggggttgtcgaagttgctgtccatctcgcaccggccaatcaggttcatgacgccgatgcgcacgccgccggggccgtcgtacacgccccagccccggccgggcacccggctggtgtagttggcggggcggagggtataccggtcatcctccagaaagtcggcgatctggatgcggttccaggtgtggttgcccagggtgaccacatccgcaccggcgtcaaagatctcccgggcctgccgtggcagaatccccacgccggacgcgttctccccgttgaccaccgtgaaatgcacgcccttgagctttttcagcccccggagatggcgggacaggtactccacgccgctgtcccccacgacgtcgcctacggccagcacgttcagaatcataacttgcctccctctcataatcagcagcctctattatatgtgattttttgcaaaagggcaatcgtagtttcttgtaaccggattgaaaccgcccctgtaaccctttttgccgtcccctatggtatgataggagacgccaaggaggatttttttatgaaactgcgccttttttccggcctggccgccctggccctggccgcgctgctggccgcctgcgccccggccgcccccgctgagcccgccccttctcccggcgcggccagccccgcccccaccgccgagctgcccaccccggtcacggaggaggaactgcccgccctctatgaggccgagggctatacggtgacggaggtgcgcggctatctagacgactttgtggtggaatacacctacggcggcagtgaaccccgccttctggactgggtgttcggagaaaccggccgccgggtgtacctgacgggtctggacgccgatgcttcctatcagatcaccggcccaggcgaggtgcgctttaccaccggcggtgtcagctcctccaccccctggaaagggctgcccgagtcgggtaccgtgcgggtgctggtggacgcctacggccgggtgccggaggacgccgttcagaccaccctggatactgtggaaacctggctggacccggcggagcccttctacatgggctggtgggagaacggccgccccgatactgaaagcggccggtttgagcaggtgtacgacgcccgcatcgatgccgacggcctgtccttctccttcatccccaacggggacagccaggagctgtttgaggggttcttcccggcggccaccaccattcccagcttcgagaccagctttgatccggatggccgggtgttcaccctccgcctctacaacacctgcctggagagcggcgcccccggctccccgctgaatgaacacctggagctgatgaactaccccggagacctgtacccctattccttcccggcgggctccctgggccgggacggccacttcctgcgggatgtcaccatcgccgaggacggggaggacgtggtggtgaccgccgtcctgacggagcgcgcctaccgcttcacagtggagacctccaacctaggcttcgacaacatcccctccttccgcatcgtattccgggagaagaatcttgacttagatgggcgggattgatatgaaacgatatctgacgctcgttctgctgctggccctctgtctgaccgcctgcacaccgaaggccccggctccgacggagaccgccccgccgccggaggccggttctgtccggtcggagatgcccgccccggtgtggggcgagcaggtctttcagcgggactatgccggcgaggaatccaacgcggacgcgccggagggggtggtggtctccctgcgctttgtcatgccctatatcgaaaacgccggggagaaccccgtctggcggagtctaaacgaagacttctccatactgggagaggggtggctggaaaagggccgggagtactggagcactccaggcctggagcccggcggggactattccgtggagagcgtctacaccatccagcggtgcgaccgcttcctgagcgtccgctaccagcgcaccgaggcgctggcgggtgagcccgcggtcactgtctccggcagcctttttgacctttccaccggcgaagcccttaccctggactccttactgcgggttccggccgagaaggggatggacgctctcctggatgctctggacggtctggaggacggcccgtacggccgggcatattttgagagctactgggatgtcaacgccttctaccttacggaagaccaccttgtgctcctcttcccggtctatgcggacggcgctacctcccccaccgccaccctggagcgccccatccccctggatcgcctccgggggctgctcagcagcgccttcctggagctctgtccggctgaccctgctccccagccctccgccccggcggcggagccgcgcgcgctcaccccggaggagatcagccgggtcaatcaggcctttgccccaggggcggaggagggcggcgtggctgacgccactccggcgagcggctttttcaccagctattacgacgatgtaagagagctggacttcgccgcctttttggagtactaccccgatgacggcacattgagcgccggggatgaggcggaatccgacgctctgaaaaccctgcccggctacccctgggacatgtcgccgggcgccgtgcccacccaccgtatcacccgcgcctcggtggacgcggccctggagcggtacgccggcatcaccgccgccgagctggccgacacctcgggcgtcccctacctggaggagtacgacgcctggtacaccttcaccagcgacttcggccccggcaagttcctgtgcgccgggggcgaggtggacgaggccgccggcaccgcccggctgtggacggaaccccgggaggacggcggccgggcggagttagccttacagcgggacggcgagtcctggcacatccgctcccaccgaattgtaaacaatccttgaaccctcttgcaatttttcatgcgaaggattatgatagcgttagcactcagaaagttcgagtgctaacgctctttgtttacaaaaccgtttgagatacaggaggcattgtcatggcaaagaaacagttcaaggccgagtccaagcggctgctggatctgatgatcaactccatctacacccacaaggagatcttcctgcgggagctgatctccaacgccagcgacgcggtggacaagctggcctacaaggccctcaccgacgatcaggtggggctgaaccgctccgacttcaaaattaccctcacccccgaccagattgcccgcaccctgaccatctccgacaatggcatcggcatgacgaaggaggagctggagcagaacctgggcaccatcgcccgcagcggctccctccagttcaagcaggagctggccaagcaggagaacggcggggagcacaccaccgacatcatcggccagttcggcgtgggcttctactccgccttcatggtggccgaccacgtcaccgtcacctccagggcctacggctccgacgaggcgtggcagtgggcctccgacggcgcggacgggtacaccctcaccccctgcgggaaggagagcgctggcaccgacatcgtgctccacatcaagcagaacaccgaggacgaccactacgacgagtacctggagcagtaccgcctggccgagctggtcaaaaaatactccgactacatccactaccccatcgtcatgctcatgcacaagtcccgccagaagccccgccccgaggacgccggcgacgactacaagcccgagtgggaggacttcgacgagtgggagaccctcaactccatggtccccctgtggcagcggcccaagagcgaggtcacggcggaggagtacaaccagttttataaggagaagtacggcgactgggaggatcccctgagcgtggtgcacgtgtccgccgagggcgcggtggagtacaaggccatgctctatatcccggcccacgccccctatgacttccactcccgggagtaccagaagggcctccagctctactcctccggcgtgctcatcatggacaagtgcgccgatctgctgcccgagcacttccgcttcgtcaagggcgtggtggactcccaggacttctccctcaacatctcccgtgagatgctccagcacacccgccagctcaaggtgatcgcgggcaacctggagaagaagatcaaggccgagctgctccgcctccagaaggatgaccgggagaagtacgagaccttctggaaggccttcggcacccagatcaaggtgggcgtggtgagcgactacggcgcccacaaggagcttttgaaggatctgctgctcttcttctcctccaaggagggcaagctcacctccctggccgagtacaaggcccgcatgcccgtggagcagaagtacatctactacgcctgcggcgaggacgccgggcagcttgccaagctgccccaggccgaacgcatccgggacaagggctatgagatcctctacctcaccgacgagcccgatcagttcgtcatcgacgccctgggcgcggtggacgaggtggacttcaagtcggtggacgacgccgacgccctccccgagaccgacgaggagaaggccgccctggagcagaaggccgaggagagcaagcccgtgctggacttcctcaaggagaccctgggcgacgccatcaaggaggcccgggtgtccaaaatcctgaagagcggcgcggtgtgcctcaccgccgacggccccatcaccctggagatggagaagtatttccagcgggtggaccccgagaacgccaaaagcatgaaggcccagcgggtgctggagctcaaccccgactcggcggccttcgccgccctcagccgggcggtggagagcgaccgggacaaggccgcccggtacgcgaagctcctctacgcccaggctcagctcatcgccggcctgcctctggaggaccccgccggctacactgagctggtgtgctcgctgatgaactgacgacaggaggacacgccgtggttgtgcagaagaaagtcccttcggtggaggcgctggagcgccttcaccgcctggcctactccgttcctgacgaggttcaggtccgctccctggacggcgccatcgctatcgacgccaaatcgtccatgggcctgttcgccctggacttttcccagccggtagaaatcctcaccgactccccggcggtgctggccgagttggagtgctggtgagtccgccgcgccaggctttgctttgcccgggaccggatagcggcggcgttccgccggatacactgcaagaccgcctccgcctatgagcggaggcggtcttgtttgcctgcgcggttctcctccagaaataagttccggggcccggcacatgtgccgggccccggaatgggatcttctctcattggggcgtcaggatgccgtctcagacctccatggccgcgtcatagccctcgcggaccgcctccaggatctggcggggccgcttgcagtcgcccaccatgcggaactcgctggagaccggctccagggccagggcctccgcccggaggggcgccatgccggcggccaggatgacggtgtcggcgtcaagcgtgagctccttgccgtccgcgtctctgcacacaatgccgtggtcatggatcccggtacaggtggtcctgcacaggattgtgacctgctcggcgtgatccttgagctccatcatcagggcgggcttgtggatggagttggcgtcgcgggccacgtcaatgcccatctccaccagggtcacctgcttgccctgcatggccagctccagagcggcctcggtgccagccaggccgccgccgacgatgaccaccttctgcccgacctgtaccttgccgtcatacatgtccatgatgggatgggccttctccacaccggggatggggggaatcagggccttggagcccacggcggcaatgcagaagtcgggggcgatgacctttaccagctcgggggtgacctcggtgttcagccggatatccacgcccatgcggacggccttggcaatcatataatccacatactgctgggtctcccgcttgaagggcaccttccgggcgtagcggagcaggccgcccagcgtgccggttttctcgcagaggatgacctcatgcccccgatccctggcgacaatggccgcctccagtccggcggggcctccgccggcgatgagcacccgcttgggcgtggtgggcaggaaggggaacacctcgtcctccggccggtccagggtggggttgatggcgcacttggtgatgcgggtctggtagttggcgatgcaggcgttgcagcgcaggcaggggcggatctcctcctcctggttcctcttgagcttgttgacaaactgggggtcggcgttgaccgcgcggcagacggcgatcatgtccaccttcccggcggccaggatatcctcgatcttcttgggatcccggtgggcgcccacgctcaccacatgggagtgcttcacgtgcttcttgatctcctcggccaggtagaggttgtggccctcctccttgaacatgccgggcaccatcaggcactcggtctccgggaagtagaagttgcaggcggagacatgcagcagatcggccctgccgtccatcagcttggcaaactccacgccctccttcagggtgtagccgccctccacgtactcggtgccgctgaagcgcacctcgatgaggaagtcctcgccgcagtactggcggatgcggtcgatgatcatgagcagcaggcgggcccggttctccaggctgccgccgaagcggtcggtgcggtggttggtcagcggggagaggaactggtggatgagccagccgtggccggcgtggatcatggccatctcgaaaccgcaggtcttggcctgctcggcggcgcggccgaaggcgtccaccacggtctcgatcatctcctcggtcatgaagagcacctcgcccttgcggtagaccggctcatcggaggcggactggtcggacaggggggcgatggtcttggtctcgtcaaagttgatgtagtcggggccccaggcctggacgcccgcgctggcccgcagcatgccggcgtggttgagctcaatgctggcaacggcgccgtagcggtggatctcgtcggcaatgcgggtcaagaagggcaggttatcctcatgtcccgccaggatcttgggggaggccagcttgccggagtcctcgccgctggggtcgacaatacagtcgcccagggtgactacggcggcgccgcccatggcccgcatgcggaagaactgcatatcccgctcggaggggtggcgctccggggtggtatccaggtcgaacacggagatgggcgcgatctcaatgcggtttttcagggtgattccccggatggtcagaggggtaaatatgtgctgatatgttctgtccatacaataagaactccttctgaataaaatagtcgatccctgcattacagcttttcatagctcttgacgggcttgacggcgccgcttctgtagcggagctgagcaaagaggatggcgatgacggtgataatcaccaggatgatggcctggagctggctcatctggaagaagagcaccagcaccatgaccacgcaggacacgccgcccagaatggacttcaggtagagcttgctcttgctgcagcggaaggcggagacctcccaaagctccggcatgcgctgggggataaatacggtgccgaagcagatgaaggcgaacagaatgttgctgagcaccacggcggtgtcggcgatcatgctgatctgcaggccggtcaggatgggaatgaggcccacgatgtagaagcccaccaggataatgacgggggtcttgaacttggggtgaatgtagccgatcttatggggcagccagccgtcgttgcaggcctgtaggatgggcttggtgatccatgcgaaggtggcgttcagagtcgtagtcagggccaacagggcgccgccgatgacgaagaacaggaacacgggagttggcatgatcgccctggccaccaggtccagaggctggttggccgtctcggagacggggagcacgccgccggccaccatggcaatcagggcatagaagattgcgatggcaatggtagccaccaggatgacctggggcagatccttggtggggttcttggcctctgcactcaggttgaccatgtcgatgccgccggcggtggcccaggtcagcagcacggcgcaggtgatgatgcccatggggccggcgggggcaaagtccactgtaaacagggtgctgtagtccaccttgggcagtccgaacacgatgaagcaggtcatggccagggccagcacgatatccatgacgatctccagcttggccgcgccctcaatgcccagcaggttggtaatgaagaatacagtcaggcaggccaccgccacggggacaatgggcacctgcggcagcacgccctggagatactgggcgaagctgatggcgtacatggccagggagacgttggaggcaaagaagatgacgatgtagaagccggcgaacttgggaccccacagggtgcccatcatggagtaatagccgccgcggaagcgggcggtacccgccatcacgatgaagggcagtgcctggagcagaatgaagacggcggagagcagaatcccgatccacgccgacttgcccgtgtacccgatcccgattccgatcagcgaaaacacgccggagccgatcacatggccgaaggcgatggagtacagctcctttttccccagcgtccggttcagatcctctgttgtcagcattttcttttctttgttttccatggacaatcctcctctacttattggtcggcctgtgccgaccgttccctgtccgggactccgcctgcacacaaatcggagtccctcctccgacccgcggggaccggaaacgccacaggcctttcgttcaagccgcaggacggcagtgcccccgcagcctcaagcgcatattcgaaatccatgggttacatctgttttccttctccctcggcaaaaggctcctttccctttaaattagaccagactcgacctgttttttattccgattgcaatcttcatatgttaagtatagaaaacttgatacagaaaaatagccccttccctgcggatattttgggggttctgccaaaataaaaccggctgtatcccggaaaaatacaacaaaaagtacagccaactgacgaccagttggctgtacttctgtttatattgtatacgttttcggattgcccgtcctaatcctgtggaattctttttatagcaaaaattgtgggttttcatcacatttgattgaaaaattccagtgattttcctcgtttgaaaaccttatagtttttcaaagcacagcagcaggatctcaaagggggccagcttgagggtcagatagtaggcgccgtccagctccagaagattcagggacatttcaggggccagtgttccgttgagtacccgcagcgtctctgcggaaagtctatccgccagcggcagggggaaatcccggtacctggatgcgtattcctcagaggtaagccggtacttccggatggcgaaccgccccgtcatgccccggacgctcagtgtgacctcccggttgtagtcgtgatccttcatcaactccacaaagggggcctgttcctcgacccgggagccaccctcgaacagcgtgtcgaagcacgcgtcatagtggtagagcagcacctggatgtcctccctcccggactgcctggcggccaggtacatatcgccctgggcgattaccgtgtcgcccaactgctccagcagggagagcaggtggtagaccgggcgcttgagcccctccggggtcagcagggccacacccgaatccccgtccagcagcgtgagccggggcatacggctccctcggcttgaagccatggtgtggaggaggtagcccggcatatagccggagccatacagcgcattggcttccggccggtgctctgccccggtgacgcgcaccggaagccggaaggcggacagggcctccgccagagtcctggcccgctcctcctccccgggagccgccggaacgatcacctccagttcaccgccgggccgcagaaaacgctcccgcaggggctccaactcctccctcagcccccggagcggctcccccggcggcacacacacccgcagcctcattctcagcgaccacagatcattcaggatatagttcagcactctggggctgttccggtaacggcgcagaaagtccagatcaagcgcaacggtgtccagccccagctcctcccgcagccgccgcagctccggaaagcaggtgatatggtcgtaggcggcacccgccaggctgacgcaccggggcctccggaggggcttctcctcataccgtccgccccagtccagcgagatttcctccgacttccggcagaacttttgcagcaggagctccagctcctgcccctccagtgccctgcagctatatgcctgcaccgcaatggtgcggctctggtacctgcgccggtactgctgtggcgtggtgcgaaagctcttttcaaagccgtcgctgaaatatttgtacttggaaaagccgcattcgtaggcgatggtctggagccccttgcccccctccagcagcatggccgccacatcctcaatgcggataggcttgttgtagttgcggtagatgtagtccgtgatccggcggatgcgccggagctggagctcgtttcccttgtaggcgttgttgaactcgggaaagccgctgcccagataatagcactggaactccttgatgagagtgttgagaatcttctcccccacctccctgtaggcagccgtctccgtccccgtccggtccagcagcctggggagctgctttttcagatagctgcccagcatttggattcccgcggtattgttctccagggcactgttggcaaactggtaggtccgcaggtccggaaactccgcccggtatgcctccacattgatgtgcagcagcatcaccgtcccccgggtgtggggataggcgcagagccggtgcagctcccgcggacagctcacgtaaatatccccggccttcatgtccagcacgttgttgaccactgtgagctcaaaggagccctccagggcaaacatgatctccagaacgtcgtcgtgcatatgaaaggggtattcctccacctccacgatactgcactgcagcggcgcattgtcgggaaacgcgattgtctcatacagcatgtcccttccgtcctttccgttgtgctccggctccgcgggtgtcacggccagcctttgggggatattttaccgtattttcaaactgctttccagcaaaatctggatttcactctgtttctctctccgcatgcttttgacagcaggccattgtaaaatatatacaagaaattgcatctacacctttcctatattgacgttttttccaccccatgctatcctattgtcatagtactgttacaggaagggggatcgattccggtgcagcaacagcagtaagatttcttccatggaggaagcttgagaaccacatttcatgaaggaggcctcgaccatgaccatgcgtatccaccgcgcagtccggaccctctcccttctcctggctctgagcatgctgctttccgtcagcgccatttcctccgcggccgaaacgcccgccccttccgtactcaccgtttcggattctacgctcgctttggttgaccgggatcaagcctttaccgccaccctcaccgtagacgcctcggtactgggggacgcctctcccgatgcctgggccgccggccttacctggtacctcacccgggaggagggcttccaggacgggacgctctatccctattactaccccggcgaccgcctggaccgctggcaggtctggaacaacggcgaaggaggcgacgcactgttcaccccgggcgatgcagccgcgtcgtccagcggcggcaaggtcaccgtgaccctgccctttaccgccggttcctttaccggcatcaacggcgactcctccaaaaaccggaacgcctggcccagctttatcggcacgtacaccctgtccgcccggagcggtgataccgtagtggcggagacggacatgacggtgaatgcctatgacagctatgtccgctacgacgacattgacgagtccatccaggacatcatcgacgaggcgctccccggccggtacatcaccgtcaccaccttcggccagagcgagggcggccgggaccagtattacgtcaccctgtccgacagcaaggcgtccgtggacgccttccaggccatgaacgccatcgccgagaccgaccccgcctccctccaggacaagctggagaagggctccatgggcgactaccgcgtgcccttcttccttaacaacgtccaccccgacgaggaccccggcgtggacgcccagctcaacgtcctgcgcgccctggctacacaggagaccgttacctacaacaccctcaccggcttcaaggacaagagtgtggacatctcggagatgttcgcccccgacgtgctggacctgggcatcaccggcctgggctcccagaagttcaccagggatgcggagggcaacattcaggacaacaccggcgtcaacgatgccagtgagctctataccatcagcggcgacatcacgctgaaggtggacgacattctggacgacatcatctttgtcatctgccccaatgagaacccggacgggcgcacctacaacacccgccgcaacgacaacggctttgatctgaaccgggacgcctccaaccagacccagaacgagactaccaatctggtccaggtgatcaacgactggaacccggtggtattcgccgagctgcacggctacatgaccgaattcctggtggagccctgcaccccgccccacgagcccaacctggaatacgacctgctggcgaagaactttgcgctgggctccgaggctttcggcacggctgccctgggcaccatgtcggccacccgggaggagcatcccgacaccctgtactggtcctattacatgcctctgcgggatgactacgacccctccaccatgcactggtccgcctgggacgacctgtgtaccaactacggccccagctacgccatgctcaactgcggctccctgggctacaccattgagaccccctataacaacgaggcatccaccgacctgttcgagtacggcgtctacggcctgatcgactacgtcatggagcacaaggacgacatctaccacaaccaactggagttcttccgccggggcatcgagaacgaagatcaccgggacagcatggaaaagtggtatgtggatgtgaacaacaagcagttgcagtccgatacctggcgcgtcccctacgaggagaacgacaattatttccccgagtactatgtcatccccgtagacgccgcctcccagcgcgatcccgccgacgcctatgcgatgggccggttcctgctgcgcaacggcgtaagggtatcctcgctggacacggacaccgccgtgggcggcgtcacctacagggccggttccctggtggtggacatgcatcaggccaagcggaactacgccaacgccgtcctgtgggagggcgccgacgcctccgcctccggcttccccgatctgtactccgagtcggttaccaacttccccgccatgcgcggctttgactgcatccccatcgccgcagagggcgcctttgacggcaagctcaccgaggtgagcacggtgaccggcagatcccagctcactggcacggcgggcgacgtggtcatcctctccaacaacggcagcgaggcggtccgcgcggtcaacgccctgctggatgccggccgcaccgtaagcctcatcacctccggcgaccacaagggcgactttgctctctcccttgccagctacgagacggttgcggacgactttgtgctctccgccacccggacggccgagtcccccgcggccagcgccatccggaagcccacgctcttcctcgcaggccgctatgacgcattctccggtgccaagctcacggagggctacttcgcccagtggttccgcgacggctacggcttccggaactaccgcaacgtctacagcaacggcacctccaactacgacatagagacctacatcgaccagctgggcttcaccgtcaccgacgatcccgccaaggcggacatcatcgtgggcaacgtagccctggatcagggggagaagggcgcggccgccgtggccgctgtcaaggccggcaccccctacatcgccaccggctccgacccgctggagtacatctccaaaaacctggtcaccgacctgacctacaccaccctgggcatggaggccctccataccgtcacctatcccaccgacagcctgatcaccgccagctacgccgccgacggcgaccatgtgctgtatacctatagctgcggcgtgctcacctccgcccccgccggggccacggtgctcatccaggccgcggagcaggacagctttatcgccggctgctgcctcaacgagaacgggactcccattgacggctttgtggaggccatcgccctggagcgggacggcatggatctcaccatctttgccaactccgtcaacaaccgcgcccaccagcaggacgactaccgctatgtgaccaatgccatctacgccaaaatgagcaccggcggcaccgggttcaccgatgtccccgcaagccattgggccgccggcggcattgcctatgcggtggagaacggcctcatgaccggcacctcccgcaccacatttgcccccgccgccccaaccacccggggtatgatgatgaccatcctggcccgccaggacggcgtgagcacctccggcggcggcacctggtacgaaaagggcatggcctgggccaaggaaaacggcatctccgacggaagcgcccccaacggttccatcacccgcgagcagctggccgtcatgctctaccgcgcgtccggcgctgacgccggctctgcggagctgagcgcctttgccgacagcaaggcggtctcctcctgggctgcggaggccatgagctgggccgtggagcagggcgtcatcaccggcaagaaggggaaccttctggaccccggcggcactgcctcccgggctgaggtcgccgtcatgctccaaagatacctcggttgagcttcccttccaaaaatgactgcgcgcgccgcctgagagacaggcggcgcgcgcagtctgttttttccgtttctccccggcagccctcgtttttggcccctgtcgcgcataggatagaatggcggaagccggacggttcccgccgccaaatcaaaccggcgctgtccgccgccgggggaggagagcatatggatcagatccgaatcggtatcgtgggctacggcaacctggggcgcggcgtggaatacgcgctgcggcagaacccggacatggcgctggtgggcgtgtttacccgacgcccgccctccagcctcacactccagacgcccggcgtacccgtgtatccgctggacgccctggacgggatggagggcgccgtcgacgtgctgctgctctgcggcggcagcgccgccgaccttccggagcagagccccaggtacgccggacgctttcacctggtggacagcttcgacacccacgcgaacattcccgcccactttgccgccgtggacgccgcggccagggccggcgggaagacggccatcatctccgcggggtgggaccccggcctcttttccctggtgcgggccctggccgcggcggtgctgccctgcggggagagctacaccttctggggccggggggtcagccagggccactccgacgccgtccgccgcatccccggcgtccgggacgcgcggcagtacaccatcccggtccccgccgccctggatgcggtgcgcagcggcgccaatccggcgctgaccacccggcagaagcacatgcgggagtgctttgtggtggcggaggagggggccgaccgggcccgcatcgagcaggcgatcatcaccatgccccactactttgccgactacgacaccacggtgcactttctctctgaggaggagctgctccgggaccacggcggcctgccccacggcggctttgtcttccgcggcggccgcacgggccggcaggaacagaaccgggccctggtggaattcaggctgacgctggactccaacccggagttcaccgcctgtgtcctgaccgcctttgcccgagccgcctttcgcctgggccgggcgggacaggcgggctgtaaaaccgtgtttgacattcccccggctgccctctctcccctgtcgccggaggagctgcgccgacagcttctgtagggggcgtttcagcggacgcggttgcgcagcgcctcccccgccagatagcggcgcaggttgtccagcgcgatgcgggcgatgcggcgctcggtgtccgccaggtggtttcctccagcggtgtggggtgtgatgagcgccttgggctgccgccacagcggatgctccggcggaaggggctccgggtcggtgacatccaggcccgcgccccacaggcggccatccgccagcacctccgccagggcctggccgtccacgcagctcccccggccgccgttgaggaggatggcgtcccccttcatgcgcagcagccgcgccttgtcaaagagacggacggtgccgggggtttgaggcagcgtgagggccaccacgtccgccgcggggagcagcgtatccagcgcttcgaagccgtacatgcactcgatgcccgcggcagacttggccgggtcccgccgcacgccgctggtgcgggcccccagggtccggcacaaccgggcgaaggagctgcccaggtcgccggtgcccaccaccagcacctgagcgcccagcagagtcttgacagggcccaggtccctccaaagcgccctgttctgctggtcccggtaactgggcaggcgcttcatcagcgccagcagcagtgcgaacaggtgttctgacaccgaatggccataagccccggtggagcaggtcagcgccgcctccgagggcaggacgccgggggcggtataggggtccaccccggcactgcgggtgtggagccagcgcagggcggtgctcccccgcaggcactccggcggcgggttgcccagaattacctgggcggactgccagtcctccaccgtcagtccggccccgtcggggtggaaccgctggggggccaggacggcaaaggccgcccgctcctccccggtcaggttaagcagatttaaaatgatggattccatgaaccttctcctccctcagaggcgtttttcaccgcgcaagacgcagcggcggatacttacacatcataggaccatccctcgccgcgtcccgcagcttcataaaattgaaccgctcggcagaaaggctaagtcaatggcctgaacatcctcccatgtcaggaattcaccccggcacgcagctggggagaatccccgaaaaaggcgttaggcctgggcgctctgcacgtagcgcatgaggatggcggacacctcagcgcggctggccgtgccgccggggtccagccggccgcccgatttaccggtgatcaggccctgtgccaccgcccagttcatggcctctctggcccaggcgctgacaccggctccgtcggcatagccgctcaggtcgtccgcgctcacctgtccgccggcgtagcggaagagaatggcggccagagattcgcgggtgagggcggcatcaggagagaagcccttgccggtgccggcgacgatgcccttggataccgcccagcgcaccgcctcggtgtaccactggtcctcgtccacgtcgtcaaagtccatggcatagttcaccacgggggagcccgcctcccgccacagggcggtgaccagcatggcgcgggtcatgggctgcccgggggcgaaggtggaggtgccggtgccctgcagcagcccctggctggtgacgaactccacggccccggccgcccaatgggtggccggcacatcggtgaaggttccgccggcggcaggctggaaggtatcggtcagattgtcagccagctgaatctcactggactggtccagggtcacagtgtaggtagcgccggactgaagctgggccagcagagcctcggcctcctcccggctgtccaggcgctcggtacggaggatctcaaaccagttgtcgtggacgctctcaatggggcctccggcgcagcttccatcatagccgtcgctgacgcgggcgcccacctggacataccaggcgtggggatcgtgggtaaaggaatccttcaggatgaagatgccgtcgcccacgtcctggccctgggcgttttccacgccggagagcttgttggtctggttcatatagcggttaaagccctggatgatcctaccgccatcggtgagggtgatctggtaggtgcctccctcgcggcggtagggacctgcggcctcaatggtctggagctccgcgtcggtaacggtgatttccgtgccgaactcgtccttgggatctgccttccagttctggtagtaatcctcgtaggtgataaccgcctggcgcttttccaggaagtttacccactcatagctgccgcggttcacggcctccaggaaggggatgcccttctcctcggcggccttgttgatctccagcatggggtactggttggtgtgctgaggaatcatgtagtccggctccacagtttgctgcaggtagcgcaggccgtactggaaggacaggcgcagataaccccggttctccgggtcgtcgtcggggtcgtacttggtgttgccgttaaccccgtagccgcccaggtaggagatagtgagcgtctcgttggtggcagggtcggtcagctcgaagataaatgagtcagtaccgttggtgtggccggcggtaagaacgggtttgatgcgcacgctgccgtcaaactccatccacgtatcattgatgtagaacttgtccacggcgttgagtaccggggtatccttaatgataccggtgatctcagggaagccgtagatatcgtaaccgtaggtgtcctcgtagcactcgtaaaccacggggtctccgccggcgtttttgatcatggtgtccagctcggcgccggtgccgtactgatcgccgtggccgtgagtcaggaggatatagtcaatgtctctggggtcgaagcccatggcctctatgttccgccagtactggtacccactggcgggccagcccgcgtccaggaggatgagggtaccgtcgtcggcctgggtcagatagatggccacctcgttgtcgcccacgtagtacagccggtcagggatgatggcgaaggactccgtggcggtgagccatgcggccgccgtgggcttggccacagttttgccgtcgttctcggtcataaagctgtcgatgggcatgtggtcagcggggtacaggtacttctcgtcaatggtgggctggggggtgatgtagtacagttccaccacctcggcctggtcagcgttgcggtagttctggtcaaagaccaccataacctgctgacggttggcggtcttgtagaattcgccgtcggttttctgagtgacgggtacgtcgctgagccgcctagccgtgagggtgctggtgtcggtgttgaactcgtagaccttcacgtccggggccagggtgtaggtctcgtcaaagagatccaggtcgcccacggtgatctgattgcccgacttggcggtgagccagccggtggccagcatggcgccgggttcgccgttcaccggggagagctcggcgccgtacttcatggtatcgaaatagacggtgcccaggtcggacatgtacgccgagtagatatttttgatgttgatcagctcaccctgttcgttgtagcacagttcaatggtggagccggcagccaccggattgtccgccaccgtaatgagcgccacgtcggtctcggtcatgccggtgggggtgaccctctcgtgcttggtgccctggctgtcggcgtaggctacgtccagcgtaacggtatcgtcggcgttggtcaccggatcagagaccgcaaaagcaaggcgagtactggcaaactcggtgctcactggcccgtgctccatctccgtcctgccgggggccttgacccgtccgggttctgcggccagcgcgccgggcagaaccgaaaggcatatgcatgcggccagcgccgaggcagcggctctcatttgaatgcggtgcttcatacagagattcctccttttttcttgtggatggcgttcggtcgtgaagctaaagcattggaaacaccagcagcatatttggatcttaccaccaaactattcggcactcaaattcgtttttttaatcactttaacagaaaaagcggataagcgcgcctgtggtggggttcgatgccgcagggacagcagaattagaaacactatggcaaaatatcaaaataaattagttttcctaattgagcgatcagtttaatccgtttgccttcttgggagggccgtgataaaatgcagccacagtgtcaggaatgtattccgtcctgaagggagggccgggccgctcactaccgaggcgtatccgccaactcacctgaattggaacaaaggagtgcattgtaatggccaatacccccaaagtggccgccatggaggtctatcccgtggctggcaaggactgtatggagctcaacctctccggcgcccacgccccctacttcacccgcaacattgtggtgctcactgacgaccggggcaataccggcattggcgaggtccccggcggccagaaaatcacccgcgccctggagaacgtgaagcacctggtggagggcaccagcgtggccgactacaagatgaccctgcggaggctcaacgagtggctcacggccaatattaaggacgacgtgcggggccagcagacctttgacctgcgcactggcgtgcacgtggtcaccgcggtggagactcccctgctggacctgctgggccagtatctggaggtgcccatggccgccctgctgggcgacggcatccagagggacagggtccgctttctgagctatctgttctacgtgggcgaccgcaaaaagaccgatctgccctatcactccgagcccgactccgactgcgactggtaccgcctgcgccatgaggaggcgctgacccccgacgccatcgtggcgctggccagggccacctacgagaagtacggctttgaggacttcaagctcaagggcggcgtgctggacggcagggaggagctgaaggccgtccaggctctgaaggaggccttccccaaggcccgcatcaccctggaccccaacggcggctggctgctgaaggacgcgctggcccttgcccctgagctgaagaaggttctggcctactgtgaggacccctgcggcgccgaaggccgcttctccggccgcgaaattatggcggagttccgccaggagagcggcatgcccaccgccaccaacatgattgacaccgactggcgggagatgcgccactgcatcgccctgcgcagcgtggatatccccctggccgaccctcacttctggaccatggcgggctccgtccgggtgggccagatgtgcaatgatttcggcctgatgtggggctgccactccaataaccacttcgatatctccctggccatgatgacccagtgcgccgcggcggtgcccggcaagctcaacggcatcgacacccactggatctggcaggaggggctggagcgcctgaccagggcgccgctgcagatcgtggacggctgcatcaatctgccggagcggcccggcctgggcgtggagctggaccgggagcagctccagaaggcccaccagctctacctggacaactgtctgggcggccgggacgacgccgttggcatgcagtacctgatccccggctggaccttcgatcccaagcgcccctgcctggttcgctgatttccggtttccctgcgattccacatatcgtttcagagacacggcgcggccgggacggattttctctgtcccggccgcgccgtttgatcccacgccaatgagatttttcagccgcgccatctcccgctttacaatctttacaaccggcctttccttggggtaagatgagaacgaagcagaaggaggaatcgacatggcgagatttgcgctcctgctcccccgtgaggagatggtggagcccgccgggcggatcgcccgggagctggagatggatgtggtgctcaaccagtccgtccccaccgagcggattctagacctcatggaggattgtcggcgcacaggcgccgacatcctggtggcccgaggccgccaggcgtccattctcaaggagcacaccgacttcccggtggtggagatccagctcaccggcctggagatcgcccggctgctccaccgggcccgcagcctggtctcccatctggagcggccgaagatcggcgtggtgaccatccccaacatggtggggaatattcagggctttgaggagattttcgacatagagctgcacacctattttatctccggcctgtcggagatggagcgcggggcggagcaggcggtggccgacgggatggatgtcattctgggcggcgactttgtcaatgcctactgccgccggctgggcaagcgcaccctctttttcgacgggacggaggactccctgcgcaccagcctgctccacgcccgcaacgtggggcaggtcgccgacgccgagcgccgcaacacggcccatctgcaagttctgctggactactccttcaacgggattctggagctggacgcccggggaatcatcgtccagagcaacgacgtggcctgtaagatcctggagcaggagcgggagaagctggtgggactccctctttccacgctgatgccccgggaggacgccgagttctgggccgacgcgctggcccagcggcgggagctctacttctccgtgctcaacgtggcgggggtgcacgtggtggccaatgccgcccccgtggcggactgggacgccggggagggcatggtattttccttctatgagatgcagaagatggagcgccagggagagcgggctctgcgggaacgctaccggcttcagcgctatctggctcacggccggtttgaagacgtgaaccacaccagccgggagatgtcccgcctggtaaagctggcccgcacctttgccgaaaccgggcagcccatcctggtctacggcgaggtgggcagcggcaagtccctctttgcccagagcatccacaacgccagcccctgttccaagggccccttcgtgaccttcgactgcgcggcccactcccctgagcaggaagccgccctgtcccgggcgggcaaggcggcggacaccggaacgctctatctggacaacctggaccagctcacgcccggcgggcagcgggtgctctgccgtctgctccgcgagggcgtggtgcatgtgcagggcgagaacacccccaccccggtggcggcgcgggtcatcggttccctgaccggggacctggcccccaagctggaggccggcgtctttcagcccgagctctactatctgctcacccccctgcggctgagcctgccgcccctgcgcacccgcccggacgatctgaaccaggccatcgacatgtgcctggacgactgcgtggtgaagttcaaccgctatgtggtgctcaccagggaggcccggcggctgctcatggactacccctggccgggcaactacatccagctccgcgcctttctggagcgcatggtgctcaccgcccccgcccgcacggtaaacgacggctatgtgcgctccctgctggaggagctctatcccctcccggtggtccgcgcccaggggcaggccctccccgccgccgtctcccccgaggccgcccggctggcggaggtgctctcccgcaatggcggcagccgggccgcggccgccgccgagcttggcatcagcaaaaccaccctctggcggcggatgaagcagtatggcatccgcgaccgattcgagggctgacccaacagcagacagggtgcgcccccggcgataccggggggcgcaccctgtctgctgtttgctatgcaaaagcatagcaaaattggccatgtgccgctttcagcggcacggccatgaaatcaaagcgcatgggccgagacggcccatatgcgcataaactccatgcgccacaagcctttgcccgttttcgtggtgcgctcttggcgcatgaagttttataccagggcgtccgaggccttgagaattccgtccagctcggggagaaaatccacctcggccacggcggcgctcggcgggacgcggctggataccttctggcccaggatacggttggtgacaaagacatggaggcggtctccctggacgcagacggccaggggcttgtcggtggcggcggacagccggcgcagggcggcgaggaaggcgtcaccgggcacgtcgggtttgccctccggccggagggcaaaccaggtgccgtcctccatccagccggggccgaagcccaccacccgccgcagcccgctctcccggcgcagcatggcgtcccgggacggcttcatcatcacccgctcgtggatgagccgccagtccagcccggtgtccttccccagctccaccgtcacccaggtgcccaccacgaactcgtggtgggttttcccctccatggagaaggaatgggtaaacccggcgtcacccaggcgcacacggcggccgtggtaggtaccggagccgccctcccgcaccaggacggagcccttggcgtcgttggcggcgaccaggcgggcgcggcgcagctccccctcctccagggtgggcgcttcggtatggcgggcgtcctgaaggcgccgggccagggtacactggccgcaggcgtggacaaaggcccgctggtaggccttccccgccctccgtaccaccaccaggtggtagaccaggctggccgccaccagcgccagggtaacgcgcttgtccacaaagaagaagaccagcgccaggacggccgccgccagataacccaggtagagcaggcgcaggcggcggtattggcggatgaggccgcttaccagctccgcagattctgatttcatggtgtgacactccttttgaccagaacggtacaaaaactttgtattcatgttcagtgtaacagagatttttgttccgcacaaggagcagcaggcggagggcgaaccgcgcccgtccttatctgttttgcacaaattttacttgttttttctgacaaactataaaaatcaaccgataatttctataaatttacagttttaagcgaaacaaatattccatatttgaaacgcagaacgggtatttttgaaatcttaaattcatttttctgaaacccacacagagtttacaaatttactctcccatttcattgccttttgcgaatggaaaacccatgctgcggcctgctatcatagtgccacggtagtgaagcgcccccatcccccgcaagcacgcacggaacatccccagtgtatgaactgaatgaaaggaaggaatcgaacaatgaagttcaagaaactgaccgctctgcttctttccgcctccatggcagtcggcctgctggccggctgcggcggcaccccctctaacacggaaaccggcactccctccaccggcgatcccggcactgaggcgaccggcagcgccgcctccggcgagagcagcctgaagggcaagcgcgtccgcgtggtcatcggctccacctccaccggcggcgactcctacatgatcgccgacatggtcactcgctatctgggcgaggagatgggcttcaacggcaaggtggacgccatcggcaacgcccaggcgctggacaccatctccaaggccaagggcgacggcaccaccatcatgatgttccacgacatggcgttcctgagcgtactcttcggcgcggtcagtgaggactacgccctggagaacctgaccgtcggcccccgcatcggcgtcaaccccggcggctgctttgtggccaaggccgacgcaccctacaacaacctgaatgaggccgcccagtggctggccgataaccccggcgaggagctgcgggtgaacattgagtccggctccgcctcccacctggactttgtggtgtggtatatgtgggttcaggagcagtacggcgacgaggtggccagccgcatcaaggccctggtgggcggcaccaccgacgaaaagaagcagcgcctctgggacggcaacaccgacatcatctacgccgactattcctcctgcgtggagttcaccaaggagggcgtggacgcccagctggccatgaagctctttgacacctgcggcaacctggagggcagcggcgttatctccatggccgacgacggcatcaccttcaacggcgagcccttcgacttcaacaaggacttcttcatgctcttccccaaggacatggacgagggcattctgaatgagatcgccgccgccatgcagaaggtctgtgagaaccccgatttccaggctgagatggccggcctgctctacagcgccgtcaccgccgaggaggcggatctggaggcctcccgccagttcatcagcgacaagcgggacatcggccaggagatcatcgacgtggcccccggcctggacgagctgacctaatatctgttggagtgtcaccccgttgaagcccagccggcggttggcgcttcagcggggtgatattctgtgataccaccctgcgaaagagaggtaataagatgcgtatcaatgtggagtattcaacccagcactggattttccccatcatcaccattggaattctggtgattctgggcgtcctgctgatcgccctggaggggcgggcccggatcaaggcgggcaagggcttttttgtcaagcccggccgcttcttcgtggaacactacgacaagttcaaattctggggtacgatcgccctgatggtggtctacttcttcctgctggacaagctgggcttcaccttctggtccatcatctgcctgttcctgttcaacaccctgtttgccaacaaggcgcagctgaaaaaccccaggtaccacatcaccagcctgatcatctccgtggtggcctgcctgatcatcagcgttgtgttcggcaccgcgttcgccatcaccctgccctccggtctcctcaccattgagattccgtccctgggcttcattctctactaaagaaaggctggtgtgattcatgggatttgaactgcccttcgtgatcggcccggagtacatcgccgtggccctgttcggcgtcgtcatcggcatcatcttcggcgccatccccggcatgacggccaccatggccgtggccgtgttcctccccttgacctacgcctactccatggagatggccctctatctgctgctgggcctctatgtgggcggcatctccggcggcttggtccccgccatcctcatcaacattcccggcaccccgtcgtcggtgtgtacgaccttcgacggacacccaatggccttgcggggcgagggagaacgcgccctgaaaatcggcgtcacctcctccttcatgggcggcatgatctccctggtggtgctggccctcttcactcccatcctggccggctgggccatcaagttctccgccgtggagaagttcctcatcatcctcttcgccctcaccgtcatcgccgccctgtcccggggccagatgctccgcggcctgtggatcggtatgctgggcgtgctggtagccatgatgaaccagttctccgtcaacaatgaataccgcatggtccctgagttcctggagagccagatgcagagcggcttccagctcttccccgtgctcatcggcctgttcgccgtctccgagatgctccagcagtgtgagactggcatgcacgcctcctacagcaaggatgatacgctggaggtcaagaacaacgtcaagttcagccttctccacgacttcaaggggcagatcatcaatgtgttccgctccgccctgctgggcaccttcatgggcatcctgcccggtgtgggcggctccgcggcctccctgatcgcctactcccaggccaagagctggtccaagcaccccgagctgctgggcaccggcgtgcccgagggcctgatcgcctctgagacttccaacaacggcctgaccagcggcgccctggtgcccctgctgagcctgggtattcccggcgactccaccaccgccgtcctgatcggcgccttcatgctccagggcattcaggtgggccccctgttcatcaccaacaatccggtgatctggaacaccattctggtggccctgctgtgctgcaatatcctgatgtacctggtcatgttcttcccggtaaagctgctggcgaagatcgtcctcattccccaggagcgcttgtaccccgtggtgctcatgatgtgcaccgtgggcgcctacgccaccctcaacggccgcatgttcgacgtgtggtgcctgctgctcttcggcattgtgggccttctgatcaagaagttccacttccccgtgtcctgcttcctcatcggcttcattctgggcggcgacctggaggactacttcattcaggtgctcaccgcttataacggctccctgaccggcctgttcgtgcgtcccatgggctgggttatctgggcgctgatcatcctgtccgtggtctacgccgttctggacaaccgcaaggccaagcgccaggagaaggagctctccggcaagcagtaatcatcataacacctcgatgtcattccgtccggcgcgccccgcgtccggtggaatgacatcggccaaaagggagtaattcgtctatgagcgcaccgctttacatcaaggtcaaggacgcggacaacgtagccatcgcggtccacgacatcccccgcggcaccggggtcatgcccggcgtcgtcacccgggaggacatcccccaggcccacaaaatcgccctgactgacattcccaaggggggagaggtggtccgctacggcgtggtgctgggctgcgccaaggcccccatccccgttggggcctggatcaacgagcacatgctggatctgcctcagtcccccggcctggacgacatgccctacgggaccagcgtcgtcccaatggaagagctgcccgatccgccccgcagaacctggatgggctaccgcaacaaaaccggccccgccggcacccgcaacctgctgggcattgtcaccaccgtccagtgcgccgccggtgtggtcaacgtggcggtggagcgcatcaagcgggagctgctgcccaagtaccccaatgtggacggcgtggtggcagtgaaccacccctacggctgcggcgtggccattaaggcccgggaggcccacatccccatccgggcggtcaccaacctcatccgccaccccaacttcggcggcgaattgatggtggtgggcctgggctgtgaaaagctcacctacgacatggtgctccccccggaggacatcaccccggagaacaccctcaccctccagaactaccggggccacgacgccatgatgcaggccctgatggagatggccgagcggaagctgaaacggctcaacgagcgccgccgggaggagctgcccctcagcgagctgctcatcggcatgcagtgcggcggctctgacgccttctccggcctcaccgccaaccccagcgccggctacgccgccgacatgctggtgaagggcggcgccaccgtgctgttcagcgaggtcaccgaggtgcgcgacggagtgcatctgctggccgcccgctgccgcgacgcggccgcccgggacaagctggccgccgagatgaagtggtacgacgactacctggacgccggcggcgtggaccgggacgccaaccccacccccggcaacaagaagggcggcctggccaacatcgtagagaaggccatgggctccatcgccaagtcgggcaccgcccccatcgaggaggtgctctccccggcagagaagccccataagcacggcctgatctacgccgccactcccgccagcgacatcgtctgcgggccctgccagttggccagcggcatcgggcttcaggtctttatgaccggccggggcaccccctacgggctggccgccgccccggtcatcaaggtctgctcccgcaacgagatgaaggagcactggtttgacctcatcgacgtcaacgccggccccatcgccaccggcgagaagaccatcgccgacgtgggcgccgagctgttccacctgattctggacgtggccagcggcgtgaagaagccctactccgaccagtacggcttccacaacgacctgtgcatcttcaatcccgcgcctattacctgacaagagaaaggtcggtttggtatggaaatcaaacaggggggcgtcgtctcccgtctgctggccgacgtgcccattccccgcatgttccgcgccgagcagctcttcccccgggagcgcattgcccccgcagacatccccgccgccgtggcgggggagctgtcccgggagcccttccgctccaaaatccggcccggcatgtccatcgccatcacggcgggcagccggggcatcgccaacgtggacctcatcacccggtccatcgtggactttgtaaaggccaggggcgccgtccccttcattgtgcccgccatgggcagccacggcggcgccactgccgaggggcagttggaggtgctggccagctacggcatcaccccggaggccatgggctgtgagatccgcagcagcatggaggtggtggagctgggcacctccgacaccggcctgccggtgtacctggacaaaaacgcctatgaggccgacggtatcatcgtctcctgccgcctcaagccccacaacgccttccgcggcccctacgagagcgggccctgcaagatgctcgccgtgggcctgggcaagcagaagggggccgagcgggtccactccgacggcatgggcaagatcggggccaacatcccctccatcgccaaggtcattctggccagggcccccatcctctttgccctgccctgcatcgagaacgcctatgacgagacctgccgcatcgaggccatcgacagggacgacattctcgcccgggagccggagctgctccagtttgcctttgagcggatgccctccctgctggtgggcgcctgcgacgtgctggtggtggacgagacgggcaagaactactcgggcaccggcgtggaccccaacattaccggcaccttttccaccgagtacgcccacggcggggtggaggtgcagcgcacctgctttctcgatctgagcgcggccagccacggcaacgccctgggcgtgggcctggccaacgtgatcacaaagcggttctttgacaaaatcgacacggaaaagatgtaccccaactgtctcacctccaccgtcctcacctccgcccgcatcccctgcgtggtggccaacgacagggaggccattcagatgtgtatccgcacctgcaccggcatcgaccgcaaccgcgcccggatcatccgcatcccaaacagcctccacatcggccgcatcatgctcagcgaggcctattacagggacgtgaaggcgggtaaatggcccggcgtggcggcctgctctgagcccgagccgctggaatttgacggggacggggcccttctcacccccatcgaggggtagtatggacagctttttcaagatggtggacgtgcagaccgtcctcttcatctacatggcggtgggcttcttctgccgcaagaagggcattttcaacgacgcggcccgggataagctgaccgactttgtggtgctcatcaccctgccctgcatgatctttgagtccttccacatggagctcagcctggagtccctcaagcaggggggcgtggccgtcctcatcgccaccgccatggccggcattgcactgcttctgggcaaggtgctctacaaccgcttcccataccaggagaagagcatcctccagtacggcaccctggtcagcaactccggctttgccggcctgcccgtggtcagcggcgcctacggcgacgagggcctctttctgggctccctgttcatcatccccacccgcatcctcatgtggagcgccggcatctccctgtttaccaaggccgacgccaagcaggccgtccggaaggtgctgctcaaccccggcatcatcgccgtggaggtggggctggtatggatgctcttccagctccccctgccccactttgtggacgccgccgtggacaacctgggggcctgtacctcccccatggccatggccctggtgggggccatcctggccgacgtgcccctcaagaccgtgttcgaccccaagtgcttctatctggtggcggtgcgccagctcctgctgcccgccgtgtgcctcgtggccctgcggctgctgggggtggatcccctcaccgccggggtcagcgtggtgctcaccggcatgcccatcggctccaccaccgccatcctggcccagaaatacggggcggacgcccagttcgcctccaagtgtgtgtttatctcgacgctgaccagcctggtcaccgtccccattttgaccctgttcctttgatggagaaaggagccatccctatgcagcagtcctatgatgtcgtcatcatcggcggtggggtggtgggcagcgccatcgcccgggagctctcccggtacaagctgcgcatcgccgtgctggagaaggagagcgacgtctgcacccagaccagtgggcgcaacaccggcatgctccacgccgggttcctctataagaccggctccctcaaggccatctgcgccgtggagggcaaccaggagttcgaacaggtagcccgcgagctggatgtcccctttaagcgcaccggcaagctcatcgtgggcttcaccgatgagcaccggcagcggctggagcaattcatggcccggggcgaggccaacggcgtgaagggcctggagctcatcgaccgcaagcggatggatgagcttgaccccagcgccggcggaaatttcgccatgtggtgcccggccagcggtatcctggaccccttcctctacaccatcgccctggcggagaacgcggttcacaacggggcggagtaccacctcaactgcgctttcaccggcgagacccggcaggccgacggcacccacctgctccacaccaccaggggcgacttccacacccgctgggtggtgaacagcgcggggctcaactccgccgtggtcagcgggcagctgggcattcccggctatgtcattaagccggtcaaaggcgaatacttcgtccttgacaagctggcgggccagtttgccaggattcccgtctatcccgcccccaatccggacaatacgtttgacacccacgccacgcccaccgtggacggaaatgtactggtggggcccgacagccaattggcccgggatttccaggactacgagtccacccaggccgccatggacggcctcattgagagcggttcgcggatgttcaagcacatggaccgcgcttacttcatccgcaattttgccggcatccggcccaagcgcatcgaccccgccaccggcgcggtgcaggacttcgtgctggagtgccgggacgaggcgcccggcgtggtcaacctggtgggcatcgagtcccccggcgtcacctccgccctcccgctggcccgccgggccgtggccctcatcgcccggcaggaggcgctggagcccaatcccgactttgatcccatccggcacggcatccgccgttttgccgatatgaccgacgaggagcgggccgccgccatcgcggagaacccggactacggcgagatcttctgccgctgcgagaaggtcaccaaggccgaaattctccaggccatccacaaccccctgggcgtccacaccgtcaacggcatcaaggtgcgcacccgtgccaccatgggccgctgccagggcggctactgcgagacccgcatcaccgaggccctccaccgggagctgggggaggacttcagggacatccacctggggccggagggctcctggatgttcaccgggtcagtgaaaggaggggagccggcatgaacgtggaacgccatcaggcggtaatcatcggcggcgggcccgccggcctggccgccgccatccggctcaggcagaagggcgtcgacgacgtggtggtgctggagcgggagcaccgccccggcggcatcctccgtcagtgcatccacgacggcttcggcctcacccgcttcggcgagaccctctccggccccgagtacgcccagcggttcgtggcccaggcggaggagctgggcatcacctgccttaccgacaccaccgttctctccctggaggccgaccgcaccgtcaccgcctccggccccgccgggctcaaacagctccggggcgacgcggtgattctcaccatgggctgccgggagcgtacccggggcgccctggccattccgggcagccgcccggcgggcatctacaccgccggtgtggcccaggagtacatcaacctgcgcaacctcatggtgggccgggaggtggtcattctgggcagcggtgacatcggcatgatcatggcccgccgcatgaccctggagggggcccatgtgaaggccgtctatgaggtgcagccctatcccagcggcctgccccgcaacatcgagcaatgcctcaacgactatggcatccccctgtacctgagccataccgtcaccgatattcacggccgggcgcgtctggaggccgttacggtctcccaggtcgacgaacgcctccgccccatccccggcacggaggagcgggtggagtgcgacacgctgattctctcggtgggcctcatccccgccggggacatcgccaacggctccggcctggcggtggacgggcgcaccaggggcgcctttgtggatgagcactaccagaccagcattcccggcgtctttgccgcgggcaatgtgctccatgtccacgatctggtggacttcgtctccctggaggcggaggccttggcctcgtcggcggcggagtacctgaaaaaccatgctcttcccccctgtcccctggaggtcagggcgggcggcaacgtgggccacgtcatcccccagcgcatcagcggcagccgggatttcaccctctccctgcgggtgtcccggcccatgaaggccgtcaccctgaccgtgacgcaggacggccgcgaggtgctgcggcgcaggctgcccaaggcactccctgccgagatgcttcagcttcccatccgcgccgcggcgctggagcagtccggtgatttggaggtgagcgtacagtgacgcggagctttacctgtattatctgccccaacggctgtgagatcacggccgaatatgagggggacacggtgtacgccgtccggggagccacctgccccaagggagacgcctatgtccgccaggagctcaccgacccccagcgcaacatcgccaccagcgtactggtggagggcggcgaactgcccttggccagcgtgcggctcagccaccccatccccaagaaggagatctttcgggtgatggaggtcatcaacaccgtccggctccaggcccccaccgccgtcgggcaggtggccctggccgacgtgtgcggcctgggcgccgatgtgattgtcaccaaaaacgtggcccgcgccaacgcgtgagtcccgcttttatagttcctatccaccccaatctgtgctattattttaaggaggaaatgtattatgaaaatcggactgatcggtcttggcattatgggcaagcccatggcgaagaacctgctcaaggcgggctatgacctcacggtcagcgatctgaaccaggccagcgtggacgaaatcgtagccgccggggccaaggccgccaccaacgcagagatcggcgagacctgcgacgtggtgctgaccatggtgcccaacagcccccaggtgaaggctgtcatgctgggggaggacggcgtggccgcccacatgaagccgggcagcgtgttcatcgacatgagctccatcaaccccgtggcctccaaggagatcgcggcggagctggccaagcgcggcatcgagatgctggacgcccccgtctccggcggcgagcccaaggccatcgacggcaccctgtccttcatggtgggcggcaagcaggagatctttgaccagtacaaggagctgctgggcgccatgggcgcctctgtggtgcgctgcggcgacgtgggcgcgggcaacaccaccaagctggccaaccagattatcgtggcctgcaacatccaggccctgtccgaggccctgaccctggccaagatggcgggcgtggaccccgagctggtgttccaggccatccgcggcggtctggccggctctaccgtcatgaacgccaaggcccccatgatgatcgagggcaatgacaagcccggcttcaagattgacctgcacatcaaggatctgaacaacgccctggactgcgcccacaccgtgggctcccccctgcccatgaccgccgcggtgcaggagatcttccagtggctgcacaacaacggctgcggccaggacgatcacagctccattatcaagtactacaagaagctcaccggcatcgagtccctgtaaggccgcccgacacgagtgcgaggtgatcgatcatgaatacggattttatcaagggcgtcgtggtgcccatactcacccccatcgacggggaggagcgcattgacgaggccaggctccgcgaccaggtggactacgtcatcgacggcggcgtgtccggtattctggcctttggcagcaacggcgagttctatatggtagaagaggacgagatggagcggggcctgaagattatggtggatcaggccgctggccgcgtccccgtctacttcggcattggcgccatccgcacccagaagtgctgccgtctggccaaaatggccgtggccaacggagccgccggcgtcagcgtgctccagcccatgttcctcaagcccacctatgacgagctgttccagcacttcaaggccattgccgaaagcgtccccggcacccccatgctgctctacaacaaccccgggcgggtggggtacaccctcaccgccgatctcgtggacgccctggcccatcaggtggaaaacattgtgggcatgaaggacaccagcggcgacatcaccctcaccgccgagttcatccgccgtacccgcgacgtgggcttcaaggtgttcggcggcaaggataccctgctgtacgccagcctttgccacggcgcggtgggcggcgtgtgcaccgcggccaacttcatgcccgagctgatcaccgacgtctacaacaagtttgccgccggggatctccagggcagcctggaggcccagttcaagctcaaccccgtccgtctggccatggaccccgccagcttccctgtggccgccaaggacatggccgcgctccgcggccgggatgtgggcgcgccctaccggcccagcctccccaccccggagggccccgccaaggagggcttccgccgcaccatgtctgaggccggcctgatttaagcctctccgcgaggcgaccatggaggaacgcatgaaactgagaaacgactgtgatcagattgtccgccgggccatcgccgctgtccagcccgacgcggcggttcgccgcgccctggaggggaacccctttcagggcggccgggtggtgctggtggccgtgggcaaggccgcctggtctatggcccgcgccgcctgcgactgcgtgggggggcggctggacggcggcatcgtcatcaccaagcacggccatgcccagggccccatcggctccctgctcatccgggaggcggggcatcccgtccccgaccaggacaccttttccgccacggaggaggcgctggcccttacggacggcctgacagcggaggacaccgtcctctttctcctctccggcggcggctccgccctctttgaagcgccgctggtcccccaggaggagctccagtccatcacccagagccttctggccagcggggcggacatcgtggagatgaacaccatccgcaagcggctctccgccgtcaagggcgggcggtttgcccagcactgcgccccggcaaaggtattctccatcgtcctgtcggacatcatcggcgatccgctggacatgatcgcctccggcccggcctaccccgactcctccacctgtgccgatgcccgccgcatcgcggagcagtacggcctgcgcctgtcgcctgaggcctcccagtgcctggagcgggagacgcccaaggttctggacaatgtggagacccttatcaccggcagcgtgcgggagctgtgcgccgccgcatccgcggcctgccgggagctgggctatgagccggtgctgctcaccgacagcctggactgcgaggcccgggaggcgggggccttcctggccgccgtagcccgtgcccaccaggatacggactgctccctggccttcctggccgggggggagaccgtggtgcacctgaccggctccggcctgggcgggcgcaaccaggagttggccctctccgccgccgccggcatcgccgggctggaggacacagccgtgttctctctgggcagcgacggcaccgacggccccaccgacgccgccggcggcttcgtggacggcgggacaaaggagcggctggcgaggcagggcgtgcgcatctttgaggttttgaagaacaacgacgcctaccacgccctggccgcctgcggcggcctgctccacacgggggcgacgggcaccaatgtcaacgacgtggcggtgctcctcatccgccgctgagtggttcttttcccccgctgcgcccccgaccttcccacgcggagccgggggcgcgcccttttaccggcaaggagtgatcggccatggacgtcaaacagatgacctatattctcaccatcgcccaggagggcggtatcagcaaggccgcggccaagctgttcatcacccagtccgccctggaccagcagcttctgaagctggagcatgagctgggcacccggctctttttccgctcccgcagcagctttgccctcactgaggccggcagggtctacgtggagtacgcccgccggatgctggagctgaaaaacgaggcctaccgcatcatccacgacatcgccggccggaggcggggcaccctctcccttgccttcgccccggagcggggcatggagatgttcatggccgtgtacccacggttctatcagagctatcccgaggtgacagtgaccccgcgggagatcagcgtccggcggcagttggagatgctggccggggacgagctggatctgggcttcatctccaggccggagggggaggttccggggctgacctgcgtccctctcctgcgggaggagttcctgctcatcacgccccgcagccatccgctggcggccagggccgcgccgccgggcgcgcccctgacggtgctggacacggagtgcctctgggacctgaccttctgcctcatctaccgctcctccacccagcgggaggtcatcgaccccctgtttgagcgggcggggcgaaagcccaacctctttctggagaccgccagcaaccgggccaatgtctccatggtacagaaggggctgagctgctccatcgtccccgcctactacgtccagggggtggaggacgtggcctgcttccgcctgtctgcccatcccgcctggaccgtgtctgcctgctaccggcgcaatcgctacctgtccaaatccgcccagtatttcatcgccctggccgccgcctatttccgtcccgagtgcgccgcgcaagaaaaggagttgccgcaatgagccgcatctatgagatctttggcaccaatgcccacgccatgacccgcgccctgatggagtccgccggcgcagcgtgcaaaatcccctccggggcctcggtggccctcaagcccaacctggtggtggccgcctcccccgaaaccggcgccaccacccacgccggcgtcctgtccggcgccatcgagtatctgcgtgaccatggcttccgggatatctccatcatcgagggctcctgggtgggggacgacaccggccgggccttccgggcggcgggatacgaggcggtggggaagaagtacggcgtccccctcttcgacctcaagcgggacaagacccgccgggtggacacccccctgcggcccatggacatctgctgccgcgccctggacgcggactacctcatcaacctgcccgtgctcaagggccactgccagaccgccatgacctgcgccctaaaaaactgcaagggctgcctgcccgaccgggagaagcggcgcttccacgccgaggggctgatgcgccccatcgccgccctggccgccgccctgcggccggagctgaccatcgtggacagcctctgcggggatctggattttgaggaggggggcaaccccgtccccacgggccggatgctgctgggtgaggaccccgtgcagctggacgcctacggctgccgccttatgggcctggccctggagcaggcgccctatatccagatggccgaggcctggggggccggctccacccggctggaggagggagatgtggtgcgcctcaacgagccctccgcggcggcggactaccccgccccctccggcgccgtggccgccctcacccgcaccgtccaggccagaagcgcctgctcggcctgctacgcaagcctggtgcgcgccctccacaccagcggcgtacaaggcctacccatagccatcggccagggctggcgggggattcccttcgacggccttggaatcggcgcctgctgcaactacgccaaagagcgcgtcccgggctgcccgcccccggcagaggacatcctgcgcgtcctctccgcccgctgctgagccccacggggaatgcgcacctgatttccctccgaagtcaggtgcgtttctgcgtacaggcggcgaaccccctccaaatccggtatttacaccggctcctttctcccgtacaatagaggtgatttcccggcccgcccggagaggagcaccgctatggatcttctgcaatgtctcatggattcctcatcccatgccattttcaccctggatcgggatggcatcatcacccatatcaaccagcaggccaaggtgaggttcggcctctaccacaacagccagcacccccaccccgccgggcggttggagccgggcgacctggtgctgatcgccgacacagccatcggcgcggacgacggggcgctgcggccggaggatctcgcccgtatcggcatccgggagcccaggctccgcgtcaacgaccggctggtggcggcaggcgtcttcgacatgcccagccggcggcccgtctacaagttcctgccagaccaggacgcggacagcctctgtctggagaccgtctgtgaggggatcccgatccgcctctccatcgagcgccgcagcgtcaccgttacggtaagggacaccgtctacaccatcgggtatttccgctgcattggacagatggtggttctggacggggcgactggccgggtgaagttctggcaggagaagggctactccgcccgcagggagggcatcggccacctgctccggggcggctcctacagcgaaaaacgggccgggctgtccctccaggtggagggctatcacttccgcgacttctttgagggggcgcagtttgagcgggatctcgcccgggtgctcaacggacaggcgccgaggcttgaggaccgggagtacgagatcaacggctttgagctggtggccacccttctccccgtgcccggggcggagggcggacgcccggacggagtgatcgtcaagttccggaacattgaggatatccatgtgaccatcctggagcgcaacaatgccatcaagatggccgagcggacctaccgggagaccgcccgcaaggacgcgccccaggaggcgtcctttgcggagcgcttcggcttcgacaccctgccggcctccgtccggcaccgggtctacaagctgtcccagctggactgcggcatcctgatcaccggcgagaacggcaccggaaagtccttcctcgcccaggccatccgtcaggcccagccccgccgcggccccttcgtcacggtggactgcgccaccatctcccccaccctgtttgaaagcgagatgttcggctatgtggggggcgccttcacaggggcgaacccccagggcaaggcgggcttttttgaggcggccgacggcggcaccatcttcctggacgagattggcgagatccccctccagatccaggccaagctgctcagtgtaatccagaacaaggtggtctgccgggtgggctccacccggtccgtgccggtggatgtgcgcatcctggcggccaccaaccgggatctgagggcggaggtggccgccgggcgcttccgccaggatctctactaccggctcagcgccttctctgtggagctgcctcccctgcgcagttgtcccgaggacgtgtgcttcctcatcgaccggctgatggagaagattccccagaagtacggcgtccagcccaggagcctgtccggcgaggcctttggcaagctgctggcctacaactggccgggcaacatccgggagctggaaaacgtactggagaacgccgtggccctctccgagtcggagcttatctatgccgagcacatccacctggagggcacagcgcccgccccgctcacgctgaaggaacggctcaagcgggaggaaaggcagattctccggcagaccctggcccagtgcggcggcagccgtgtgaaggccatggagctgctgggcctgtccaagaccgtgttttacggcaagctgaaggaataccaactggactaaacacgtcctgtttttgggaaagggagttcgaaaatccgaactccctttcccgtttttttcacccaggttccgggtatgctggatcttgcgccccatgttttgcggattctgtctgaatttgacggccatattttgttggaaccgctgaacttcgccccccttggccgcctggcatgcagcttgcataggcaatgagacaaggagcacgtttaacgggagggagccttcgatgcagttttggaaaatgaacggcgcaggcaacgactttattatcctcaacaatctacaggaggggctgtcggcggattgctttcccgccctggcccggcggctgtgcgagcgccgcctgtccattggggcggacggtctgatggtggtggagcggccgcagtccggcggggactaccgaatgctgttttacaactccgacggcagcgcgggcgagatgtgcggcaacggggcccggtgcatctgccgctatggctatgagatcgggctggccggagagctccagagggtggagaccaccgctggcctggtcaccggccggcgcatcacccggcggcagtataaaatcgaactcaaccggcccaccaccctccggctggactaccccgtggaggtggacggcaagacctatccctgctcctatgtggagctgggagatcccggtctgccccacgcagtggttccgattccgggactgcgcggccggccggaggcggagctgttcgccctggggcggaagctgcgggcccaccccgccttccccaagggcgcaaatgtcaatttcttcgatgtggagggaccggggcggatctgggagcgcacctttgagcggggcgtggagggcttcacctacgcctgcggcacgggcaccggctcggtggccgccgtgctgaccctccagggcgcggtcagcggccgggcggtggccgtccagatgacggggggcgagctggtggtggatgtggagcgccgcagctccacggtggaacacctctttctgaccgggcccaccaatatggttgcaaaaggggagctcaccgacgaggaactgcccctttgagtgatagagcggccgccggtgcggtacactgagagaggaggtgacgccgcataccccaccggcagttctgtgtgttagaagaaagagaggtattgttatggacaaatccacagttatgaagaactaccgcttcctggccctgatgctgtttgccatggtagccggctgcgtggccggctggttctttcctgaatttggtcactttatcaagcccgccggcaccgtgttcatcaatatgatgttctgcgtggtggtgccgctggtgttcgcctccatctccaactccgtggccagcgtacgcagccggaaacgggcaggcaagatcatgggcaccaccgtgctcaccttcgtggtcaccggcgccgttgccgccgtcatcatgttcattgtcatgaagctggttcccccggtgctggagccctggaccgacatggccaccgaggccatcggcgagcacgcctccctcgccgacatgatcgtgaacttcttcaccaccgacgactttgtgggcctgctgagccgcagcgccatgctgccgctgatcgtcttttccatcctgttcggctttgccaccaatctggtgggcggccccgaccacgtcatcggcaagttcctcgacggcctgaccgaagtgatgatggcctttgtgaagatcatcacctattacgcccccatcgccttcttcgccctgtttgcggatctggtagccacctacggctccagcgtggcctccgcctatggccgggccatggtggtgtactatcccctgtgctttatctacatcttcaccgcctttcccctcttcgcctatatcggcggcggcaggcacggcatcaagactatgttccagcacatcgcaaggcccgccatcatgtcgctgggcacctgctcctcctccgccaccatccccaccaacctgcgtgaggcggaggacaccggcatccccaaggatgtggccgatatggtcgtgcccatgggcgccaccatgcatatggacggctcctgcttctcctgcgtgctgaaaatcgcctttgtcctgggggccatgggcgtggatatgccctggaccatgctcccggcggtggtggctgtggcggtgctctcctcggtgggcatgtccggcgtgcccggcggaggctacatcggtgagtacatcatctgctccatcttcttcccccagcagattgaggttgccttccccatcctggtggccatcggcaacctggtagatcccccggccacaatgatcaactccgccggcgactatgtggtgtgctacatcgtcgcccgcgtcaccgacggcaaggactggctggacagggccattgcggccagacacgccaaatagcatccccccggggccccctgcggggcgggatatcttccagagaaacagaaaggaaatgagacatgatctgcgacaaccttaccgtctctaacgggcgcctgctctttgccggtcaggacactgtggagctggcccggcagtacggcacccccctctacctgatggacgaggaccggatccgcgccaactgccaggtgtataccgaggcgttccgcaggcacttcggccccggcgcccggcccctgtacgccagcaaggccaactccttccagcgcatctatgagatcatgcgggaggagggcatgggcatcgacgtggtgtcctccggcgaaatttacaccgccctccgggcgggctacgacttgggccaggcctactttcacagcaacaacaagaccgatgaggacatccgctacagtatggatcacggtatcggctattttgtggcggataacgtggaggagatcaaagccatcgaggcggaggccgcccggcggggtatcaagcagcgggtgctgctccgcctgacccccggcatcgacccccacacctacgaggccatcgccaccggcaaggtggactccaaattcggcagcgccatcgagaccggccaggccgaggagatcaccctcttcaccctccgccagccccatgtggagctggtgggcttccactgccacgtgggctcccaggtctttgccgaggacgtatttgaacgggccgcagtgatcatgctggagttcgccgcccacatggagaaagcccattgctaccagacccggcagcttgacctgggcggcggctacggcgtgcgctacgtcgagtgcgaccccgttctggacgtggacgccaaggtggcccaggtggccgccgcggccaagggcgcctgcgcccgcctgggcatcgccctgcccgagattcacatggagcccggacgcagcatcgtgggagacgcgggactgaccctctacaccgtgggcacggtcaaggagatccccggctataaaaactacgtctcggtggacggcggcatgcccgacaatccccgcttcgccctctacggggccagctacacctgcctgctggccaacaagctggaccagcccgccgaatttccctgctcggtggtgggccgctgctgcgagagcggcgacatcatccaggagcacgtcctgctgcccgggagcgtgggccggggagacattctggcggtatgcaccaccggcgcctacaactactccatggcctccaattacaaccgccttcccaggcctcccattgtcatgctccggggcggcaacgagtcctatgtggcagtccgccgggagtccctggaggatctgtgccgcaacgacctgtaaaaacgcacaagggagcggccccaccgggggccgctcccttccagcctgttgaaaacgtgttttcgacaggctgccggacttttggagccttttgaacggttcgaaaagtcgtttgatccgacgcgaaagacaacccggacggttttctttcacacgatctttcccttcgaatccttttgcggggagggtttattggcagctgctcttatccactcagttgagcacctgctccagctccagggtgacggtgccgtcctcccgcacgaagcaggggatgcccagggagcccttggccttggggccttcgaagacggggctgctctcccgcagggccaggtaggccttcaggtcgggcaggctggcggacaggttctggaaggtgatatccgccttggcctcaaccagcttgttgagggcgtacagggtatccgggcacaggtggctgccgatcacggtcactttcatcttgtctcctccttactttacggcaatggcttcaatctcgcacagggcgcccttgggcagagccttcaccgccacgcaggagcgggcgggcttggaggtaaagtacttggcgtacacctcgttgaaggcggcaaagtcggcgatgtcggccaggaagcaggtggtcttgaccaccttgtcgaagccggagccagcggcctccagaatggcgcccacattcctacagctccactcggcctgggcggcgatgccctcgggcatggcgccgtcggcggggttcaccggaagctggccggaggtgatgacaaggccgttggtctcgtaggcctgggaatagggcccgatggcgccgggggcgtgcttggtgtcgatgatagtcatggcagattctccttttataaatggatcaatggatggaacagacagaggtgaatggagctcagacccggctctttttggcggccgcggccttggccagccactccttgccctccaccaggcgggtgaccagcatggaggcgatggtgtcgccggaggcgttcaggcaggtggcggcggggtcgaacaggaagcccagggtggcgatgatggggaaggcctcggcggggaagttgaacatggagacgatcagcatctcgcccaccaggccgcctccgggggcgccggagaggacgaaggcggacaggatagccaccacgatggccatgccataggtgcccgcgccggagaagtccatgccgaacacgccgtagaggaaggcgatcttggtgatggagctgagcacggagccgtccatgtgcatggtgcagcccatgggcagcaccagatcgctgacgtccttgggcacgccgatgctgtcacaggcctccttgttcacggggatggtggcggcggaggactgggtggcaaaggcggtgacggcggggcgcaggatgtttttgaccatggccgccacaccgcgccggccgccggccaggaaggcgtagagggggaagaagatcaccccatagagggcgcacagggggtagtagaccagcatggagcggccgtagtcgccgatgatctcggggccgtaggtggccaccaggttggcgaagtaggcgcccaggccgatgggggccaccagcatgatgatgcccacgaacttcatgatgatgtcgttcaggttggccagcagcttgcccatggggctctgctcgccgccgcaggcggagacgcagaagccgaagaggatggcgaagatgatgaggggcagcatgttggacttgtcccacaggtcggagaagtcggacacggtgagggagctgaccagcagctcgccggcggtctgtgcctcgcccacctcgctggccaccagctcgatggtggtgcccgctgaggggctgaacaggttgacccacaccagcacgcagacgccggcgatggcgccggtgaagatgaaggttccgatggtgccgcccagaatcttgcccaggcgcttcatattggccatgccgcccacggcggaggcgatggacacgaacaccagggggaccacgatcgtgaacagcaggttgaggaagatgtcgccgatgggcttgatggtggtgccgaagttgggggcgaccacgccgatgagggcgccgatcaggatgccgctgaggatgagaatcaggttgccgtactgctgccagaggctcttcttttgcaggttcgccatatggaatttacctccttttaccagtcctgtgtgggctcaaagggccttgaccgccgcttcgagctgcttcatcgcccgctccagcacgctgcgggggcaggcggcgttgagacgcatgtagccgttcaggctgcggccgaaggagcagccgtcgttgaggcccaggcccgcctgctcgatcatgaagcggcgcagggcgtcgttgtccaggcccagcgcccggcagtccagccacatgaggtaggtggcgtcgggggcgcaggtcttgatctgtggaatgtgctcccggcagtagtccgccacaaagtcgaagttggcggacaggtagggcagcagctgctccagccactcctcgccgtggttgaaggcggcctccatggcggtgagggagaaggcgttgttgcggtggatgtccatgttcatccagaaccggtcaaagacctgcttcatgtggtcgttggggaacaccacagtggaggcctgcaggccggccaggttgaaggtcttggtgccggagatgccggtgaccacataccgggcggcctcgtcggagacggaggcggtgggggtgtggcgcttgccgtggaagatcaggtcggagtgaatctcgtcggagaacaggaccacccggtgcttgatgcacagctccaccatgcggcgcagctcctccggcgtccacacgatgcccagggggttgtgggggctgcacaggaggaagaggtcggcctcggccagcttgtcctcgaagtcggcccagtccatctcccacctgccgtccttttccacgaagggattctccagcaccttccggttccacgcctcggtcatgtcgtagaactcggagtacaccggggtctggatgagcacgctgcccccctccggggtaaagagcttgaccatggcgctgatggactgcaccacacccaggctgaagctcatcaggcgcgggtcgatgtcccagccgttgcggcgcttctgccagctccggatggcctcaaaataggagtccgggcggctggtatagccccagatgccctcctgggcccgggcggtgagggcgtcgacgatgggctgggcggtcttgaagtccatgtccgcgatccacagggggatcacctggtcggtgccgaacttcttcatccgctcgtcgtatttggcggagcggttgccgccgcggtccaccacggtgtcgaaatcatacttcataggggatcatccttctttctctcctggcctgggcttcccggccctgtattctgtccgaccataaaagcaatctatgtgccgaatcgctccgggcggcaaaacattgttaaataagcttaaaatttagtctgctgttttatgcataacagaaagaaacccgccgggcagtccaggaccacccggcggagagatgcagcagggcgcgtttaaactggtcaaagaaagaaaaaacggtcaaattggtcaaaccatttccgctccgccctccaccgtctgccggcagcacagggcccgcccggccggggtgaggcgggtgccgccccggccgcggctcacccgcaccaggcccgcccggtccagcccggccaggatgcgccgcacctcctgctgggagcaggggagccccgcctcccgggcggcggcgaggatggcctcccgccccaggctgcggccctcctggtcggcctcgtagagccgctccagcacgaagcgggcgtcctcccgggggcagtcggccagggcgggcagctccgccgggggcgcggcggcggggaggtagtggaaggtggggggcagctcctccacccccaccacagtatgtcccaggtagctgaaatactctaccacattgcgcagctcccggatgttgccccgccactggtgggccagcaggagccgctccagctcaggcgagagggtgaaggatgccccaatgttgcggcagaagtggtcgatgagcagcagcagatccccctcccgctcccgcaggggcgggatgaggacgggcagggtgttgagccggtaatagaggtcccggcggaagctgccctcctccacccggcgctccagatcctcattggtagcggccacgatgcgcacgtccaccgagatgatgcggttgccccccacccgcatgatctcccgctcctggagcacccgcagcagcttgcactggagggcggtgctcatgccctccacctcgtccagaaagagggtgcccccgtgggcgaactcaaacagccccggcttgccccccttccgggcgccggtgaaggccccctcctcgtagccgaacagctcgctctccagcaggttttccggcatggcggcgcagttgatggccacgaaggccccgccggcgcgtggggaggcgttgtgcaccgcgtgggcaaacagctccttgccagtgcccgtctcgccgatgaggagcacgggcaggggggtgagactcatcttttttaatatggtgatgcaccgcagcagggcgggagactgtcccaccacgtcgtcaaaggtatacttggcccggtagcccttgtggagaagctggctgcgcagctcgttctgccggttctccgcatcgttgaaccgctgcaccgtggcgaaggcgccgatgcaggcgtccccccgcagcaccggggccacggccacgttgatgttgactcccccggcgctcaccacccgggcgggctggggggccttctcctttaggcagcgggcaaagggcaggaagggatacaccgcgccggcggggcggtgcagagcctcgccgcaggggatgccggtgatctcctccagcttgcggttgcaggcaaagacctccccccgctcgttgacccccacgatcccctcatccagaatctccatgagcatctcaaactggctctccagccgcaggccccgggcgaacacccggtcaaagctgtaggtattggtggccacctcccgctggtactgctcaaaccgctcgctctccagcagctcctccagccccaggcggagggccgcctcgatcatggtggagctgtcgcacacccgctggccgatgtcgatgatctccttcgccccggcggggacgtagcgggtctcctggggggtgatgacgaagtcatactggcccatgtccggctccggcgcgccggggtggtagaggtcgaataccaattggttgacccccagttggttgaggcgggtcaccgcctcccggcacatcttgtcgctcaggttgacgaagagggcccgcttgcccgccggcaggctctggaggcggcgcaccacgtcccaccggagggtgacgtggatctccatcatctccccgtcgatggggacgtactggtggagatctcccagggagtcgaaggcgtcggtggtgaccatatagaggtcgtaccggcggggcatgtgctcgatggagccgtcccgcacgctgtaggagcagacggtgatccgctcaccgaacagctcctggacctgctgggcgtaaaactgcccggcgtaggcgtccagagagatgaccgccacatcctgtttcatggggttctctcctcctttttggccatttactttaaccagtttaaccgatttaacagtattctgcgggatttcccgccccatgtcaagccgatccccgctttttttcgcggatttttggctttggcggccaaaaatgcagttggcatgccggttgcatgataaaataggcagaagacttggccgccctacggggccggcggaaaaggagcgatgaacgatgcaactgaacaaggaagagatgctgaccctgctgcaccaggaggtggttcccgccctggggtgcaccgagcccgtgtgcgtggccctctgcgccgccgacgcctaccacgccatcggcggacaggtggtgtccatcaagatggaggtcaaccccggcatctacaagaacggcatgagcgtgggcatccccggctttcagcgggtgggcctgaagtacgccgccgccctgggtgcctgcctgggcaacccggagaaggggctggagctgctggaggagatcaacagcatcgtcagcaaggaggccatccgtctggtggaggacaagcaggtgagcgtgaccatcgccgagggggagagccagctctacgcccacgccgagatcatcaccacccggggcatcggcatcagcaccatccgggacacccactccaacatcatctacaccagcgccaacaacgaggtgctctttgagaaggagtacaccgccggcggcgaggacgcgctccacgccaagctcaagtccatgactgtcgcccagctccgggagctggcggactccgctggcgaggaggagctggcctttatgctggagggcgcggagatgaacgagaccctctccgactacggcctggagcaccgcctgggcatcggcatcgccgacaccctcaaggcccacctgtccaccgacatcatgggcagcagcctgatggcccgcaccatggtgcgggtggcctccagcgccgaggggcgcatgtccggctgcccctacgcggtgatgagcagcgccggcagcggcaaccacggcatcaccgccatcatccccgtggtggagatggccaggcacctgggctccagccgggaggccaccgtgaaggccctggccttctcccacctgctcaacgtctacatcaagctgttcaccggcaagctcagcgccacctgcggctgcggcgtgtccgccgccaccgccgcctccgccgccatggtgtggctcctggggggcgacgacaagcagatcggcgccgccatcatcaacatgagcgccaacctgaccggcatgatctgcgacggcggcaagatcggctgcgccctcaaactggccaccgccgcctccgccgccatcatgagcgcctacctggccgtcggcggcgtggtggtcagccccagcgacggcatctgcgccgccaccccggagcaggtcatccgcaacatgggccgcatcagcacccccggcatggtggagaccgaccgcaccatcctcagcatcatgatggaaaaggaccagggctgagccccggccctccaggcaaaaaggggcccggccgaatcgcgcgattcggccgggccccttctgcatgacgcggggcggctcagtcccggtggaccggcgtccaccacaccacgccgctgcggtatttcacgtttgcgcgccagctcccgtccggcctctgggtgaagtggcggcacaggatggccctggcggtctccccgtccaccgcgccgggggcgcagcgggcgcactccccccgcaccagggcgtcggtgtccgggtaggacagctccttctcaaaggggagcaccatcacattggcgtcaatgcccatctggtagagcacccccacgaagtagatgtagtccttccactcccagctcacccggccccccgccgcgtccagttcatggagccaggcgggggccaggccggtgttcatgcccgccacgcacagcttgtccgccgcccggtccatccgccggaagcagtcggccagatccgcctgccggtagaagcagttatagccgaagaccagatcgtaccgccgctccggcgtgaactcctcccacttggcatggaaggcggtgatattgtcccggccgcgctccgccccggcctggaggacgaagtccagtacgtcccgggagagatccacgcaggccacctcccggcacagctccgccagggtcagggtatagctgccccagccgggccccacctccagggcggtctccaccccgcgggcccgcagcagggggcgcaggcgctccagcacctggagggcggagggctccggggcataggtcttgcgtgtcatgaaggcgtgccagaagtcccgctccgcctggtcgtcggtcatccggggggaggcgctggccgccacgtgctccgcccactgccgggcgaagtcggtcatgggcacccgctccctcatgtctccccgcctccctcccagtgggtgtaggagtagagcagctccctggtgtaggggtggacgggggcctccatcacctggtcccggctccccacctccaccagccgccccctctgcatgacgccgatggtgtggctgatccaccccagcaactcgatgtcgtgggtgatgtagaggtacgtcagccccagccgctcctggagctcccgcagcagattcatgatgctggcctgtaccgacacgtccagcatggaggtgggctcgtccagcagcagcacctccggctccagcagcagggcccggcaaatcaccagccgctggccctcgcccccgctgatctggtgggggtagcgggagagcaggtagtcgggcaggcccacctgccccagcgcggcccggatcttctccatccgctcctcccggctctcccccagccggtggatggccatggcctccagcagactgtcccggatgcgcatggaggggtccagggaggcctccggattctggaagatgatctgcacccgccggtggtacgtccggctccccttccggtccaggcgtgcgatgtcctccccctcgaagcggatgcgccccccggagggcttgaggacgcgggtgatcatgcgggaaagggtggtcttgccgcagccgctgttgcccaccagcccgaaggtcttcccccgctccagggcaaagctcacccggtccaccgcccggacggtatgggtgcggaacacgccgctggagaacgtccggctgacctcctccagctccagcaccttattattcataaaggaagcacctcaccttcccgcccgtgggcagcgtgacctcccccggtgcctcccggccgcagcgctccatggccctggggcagcgggggtagaaggggcagccggtgtgctccagccgtccggggtccgggggtggtatgggcaccatgccccggctgggcagggaatggatcaggccggcggtataggggtggcggggccgctccatgacctcctccgccgtgccctgctcgatgatccggcccatgtagagcacccggatgtcgtcgcacagccggcgggccagggccagatcgtgggtgatgacgagcatgctgcagtggtgctcggtgtagatctggcgcaggacggagtacacctggttgcggatcactgcatccaggcccttggtgggctcgtcggcgatcacccaccccggccggcaggccagccccagggcggacaccagccgctggttcatgccgccgctcatctggaaggaatactggttcaggatgcgctccggctcctcgaagccgaagcggcggagcagctcggcggcctgggcctccgcctccctccgcttccagcgcccgtgggtggtgatggcctcggtgagctggcggcggagcttcatcaccgggtccagggaggcgccggggttctgggggatgaggccgatggccgccccccgcagcctgcgcagccgccgcaggggcatggagtagagctcgtcttctccgaagaagcacttccccgtcacccgggccgtattgggcagcagacgcagcagggacatgcccatgacgctcttgccgctgccgctctccccgatgacgccggagatgcgccccgcccggaaggtggtggacaggtcgttgaccgcgtacaccggcccctgggcggtgtcgaagcataccgacaggtgctgaatctcaatgtccggtaccatgctcacagctccttcaccgcgtcctgcttcacgtccagccggtcccgcagcagatcgcccagcaggttgatggacagggtcagcaggataatacagatgcccggcgcccacagcagatggggggcgctgcggaagtaccggcgggcggtgccgctgaccatctccccccagtcgggggtggggggctcgatgcccaggcccagatagctcaggcccgccaccgacagcaccacccgccccacccgggtggtgaactggaggatcacgttggtgcggatgttgggcagcacgtggcggaggacgatgcgcaggtgccccgcccccaggcagcgcatgccctcgacgtacatctcgctcttgaccttcatgacctccccccgcaccaggcgggaaaagcccacccacgaggtgatgaccagggccaggatgatgctccgggtgccccgctccaggacgcccaccagggcgatcatcagtaccatgccaggcaggccctggaacacgttggagacggcggtaatcacgccgtccacaatccccccgcagtagccggcggccacgccgatcaccagccccacggccatggagcaggccgtggccgccaccgccagcagcagggaggcccggccgccgtagatcacccggctgagcacgtcccgccccagggcgtcggtgcccaggggatgggcccggcaggggtccagcaggcgcagctccatgttcacctccagggggtcatagggggccagccagggggcgaagatggtcatgaggacaatggcccccaggatggcgcacacgagggccagcttgatgttctgtttccggcgtcttgtcatgcctctcccccctgtaggcggattttcgggttgaccgcaatgtagagcaggtcgatggccagcgtaacgagcacgaaggtggtgccggtgatgagcacatagccctggattacggggtagtcccggttctggatggcggagaggacatagctgcccaggccggggatggcaaagatgttctcgatgatggtgctcccgcccaggataccgccgaagtagttgccgatgagggtgatgatgggcaccagggagttgcggaaggcgtgccccaccatcaccgcccgctgggacaggcccttggcgttggccaccacgatgtactgctcccccagttgggccaggatgttgccccgggtgaagcgggaggtggagcccacgttggcggcggagagagccacggcgggcagcaccagggaggccagcccccggtccaggccgctggtgggcagcaggtgaagccactcggcgaacaccgtgatgagaaacagggccagccagaagccgggcaccgacagcagcagggtggacagccccttgagcaccgtatccagccatgtgccgtggcaggccgccatgagcacgccgcctcccacgccgaacaccaccgccgccagcatggcggccagggagaccttgagggtgatgggcagccgggtcatcagctcctgggcgatgtccttgttgccgatgtaggagcggcccagatccccccggagggcgtcccccagccagtccaggtactgcaccggcaggggccggtccaggcccagctcggcgcgcatgtccgcccggtcctcctccgtgggaaattcaatgccgatgcggaacagcgcatcgtccaccgggtcgccgggggcgatgcgccccagcaggaaggccgccagggagatgcccagcagcaccgggatgagcaccagcagcctgcggccgatgtacttgagaattgccatgatccaccgccttcggagacagaatacaaacggaaaataagcccccgcctcgcgggggcttcagcctgtcgaaaaagtcttttcgacaggctgctgaactttttgaaacttaaaaaagtttcaaaaagttgtttgatccgacgcgaaagggaaccctgacggttccctttcacactatccttccctccgaatcctttggctggagggttcatccacagcctcaagcccccgcctcgcgggggcttattttcacatacggttcttacccggcccagcagacctgggtgaagccggtcaggccgtacaccgtggcctgatagccggtgatgtcgctggaggaggccaccacctcctgggagtacagcacggggatgttggggaagtccacggcggagatctcctggagctccgtgtaaatctcggtcaggcggccggcgtccaggcaggcggccgcctcctcgatcagctcgtccacgtggtcattgtggtagcccaggccgtagctgatgttggtgccgccctcggtgtgcataaagcccttgaacagggagaaggggttggcggagggcaggccctggatcttgaggcacaggttgtagttgcccgcctccatctcctccttgcaggggccccagtccatctgctggatgctgaccttgatgtgagtgccctcgatgttctccagcagggactggatgtattcggcctcctcctggtagggatagcggttggcgtccacgccgggcagcaggaacagcagctccacctcctggtctcccaccacctcgcggatcagctcggcgccccgctccgggtcgtgctgcacgggctgctcgcggtagaaggcggaggtgtagttcaggaagccgccggcggcgaggccgtagccgttgtagaagctgtcgatgatggtctggcggtccagcagcagggacaggccctcccgcatgcgcacgtcgttgaaggggaaggcgccgccgttgacgttgaggaagtgggtgatgccggagtcgcccacggacacgttgtaggccggatcgccgtcgatctccgcggcctgggagggggagatggcgcccagatcgcacaggccctggacctcgccggcccgcagggcggtgtagcgggtctcggcgtcggggatgaccttgaagcggaaggtcttggcgatgccgggggtgccccagtagttatcgttgcgctcgatgacgcagtactggcccagcacgttctcggtcaccacgtaggggccggtgccgatggggaagccggcgaaggtgccgtcctcggcgaagcaggagggctcgaagatggcggagccgtagttgaccatggtgtagtccagcaggggctggccctcggagagcgtgagcaccacggtgtaatcgtcggtcttctcgtaagagaccaggccggggtagatggtgtcgatgttcatgccgtagaaggaggactcgaagggccccttcttcatgcggtcgaagttggccagcacgctgtcggcgttgaagggagtaccgttggagaaggtgactccctcccgcagatggaaggtccacacggtggagtcctcattgtgctcccactcggtggccagggcgggggcgggcttgccgctctcgtccttggtgatcaggggctcccacacgcccagggacatggaggcgtagtaggcgtcctgctcgccggggcactggtcgcgggaggcggcaaagacgatctcgcgggtctggtccacggcggcaggggtttcgctgcccgccggggcggaggtctgggcatccggcgcgggcgcgccgccgcagcccgacagggacagggcacaggcaacggcaagcagcagagacagggtgcgctttttcatgttcatgctcctctcaaattgactgacgcatgaatccatgcacaaaaaaactcccccctgttttccagagaggagccgcaatcggatgacaggccggcagaccggcgctgcacagctttccccaccgaaagaacgtgcacacaccgcaggcggctggtctcctggcttggactcatcctcacgcccgccttcccatccggcgtaccggacagtgacatatctgggcgcttgtcatccttacagtagagagggctgctgcggattctcaccgcattcccaatgaaagcaatcgctaccgtctgctgattcacttgtcggcgttcattatagccgcgcgcccccccgcctgtcaagatggcggaggcagaatatcacaattttctctcctatcccagccataagttccaaattacggttgacagaagggcgggttttttatataatatcgtatacaatcgaaaggtcaggttatgccgggtgtagcaaacctgccgtactccacttccgggtgggagtgggtttgacttcagatgcgtggagagcatcttgaggcgtttttgtgcgcttcaagatgctcttttttgtaaaacgggaggacaggcgtatgggtgtgaccaggatgggcaagaccaccattttcctggctgatgacgatgagggcgtccgccgtaccttgcgcactttttttgaggggctccccggatatcgggtggtgggcgaggcctgtgacgggatggaggcggtggagggctgccgggcgtcggcccctgacgtggcgctgctggacatccagatgccgctgctggacggcgtgagcgtggccagacaggttctggcggaccgggccgccaaatgtgtcattatcctgacggcgttcagcgaccgggagcacatcgagcgcgtacaggcgtgcggggcggcggggtacctcaccaagccttttgaggcggagaagattctgcctaccatcgagctgtgtattgcgcgcagcaaggagtactacctgctgaacaaggagtatcagcacctgagccggcgctgtcagaaccgggagcccatcgaccaggccaagctcctgctgatggagaccagggggatgcgcgaggacgaggcctaccagtacattcgggagctcagccgccgcaagggcatgtctatggcccgggtcgccagctatctgctggcccagcaggaggagcggcatgattagcgccacgcggatgctctgtcagaaatacacggatctcacggacgcggagatctcctacctggaatcctatggcgccctgctccccgccctggccaacgccgagcaggcggatgtcttcatcgactgccggaccgtcagcgggcgctctgccatcgtggtctgtgaggcgaagccccaaaccgtcccctccaactaccgcagctccatcctgggtatgctgatccactggcgggacgagccggcggtggaccgctccttccgtctggcggttcccacctccggggtgcgggcggtctccatgccggaggaccgccggatcgtccagtcggtggaacccctcttttatgaggggcggctgatggcgtcctcatctatgagcggcccgctctggccgccgaggagccgccgcccgctggggagcgggaggcggagcaggcgtccggggctctggactgggctgcggtatccccctgtctggacgacgccgttcttttcctggatgaggaggaccgggtctgcggcttcaacccggcggccacagccctctaccgccggatgggttacatcggcactctggccgggatgcccgtcaacaacattcagcccgccgccctcagcgagtgcgaccaggacaggcacgagacggccctggccaaccgggtactccagtaccagcgcctccctctctcctccgggcaggcccgggcggcgctcatcatccacgacctcacccgccagcggcagctggaggaggagctggccctgcagcggactgcacttcaggagctgcggcaccgcatgaaaaacaaccttcagatgctcgccaacctcacccggagccggggctgtgatccggccgagtccccgccggtgcagaccgcccttctggatacggccaaccggctgctctccctggccgccacgctggatggcatcgtacaggtctcccgggagaaggtctccctccttcagattctggagcagatccgccggtacatgctccagacccttctgccctccgcccgccgtgtcaccatccacgtgggcggcgaggacgtcattgtgtccgcggactgcgcctcctcggtggccctggtggtcaacgagctggtgcagaacgccctgaaatacgcctttccctccggccaggcgggaaggatcggcatcgagctccacagcgggcgccccctctgccagctcaccgtctgggacaacggcgtgggcttccaggcggaccgccctcgccccggaggcgccggtctggagctggcctccacgatcgtgcgggagaagctcaccggcgagtggagcgtggagagcggccccggcgggacgcggatctccttcgactttctggagcagtaaaaccaaatcgtgcgccgacctgaggctatggcggcgcgtacaagagcacgggcgatgcagcccagggacagcgcaggcgctgcccctgggctgttttgcataaacagccaaatttgacaagcttgaaacgggcgccgggggggcgtccggcgcaaaggagaggtgcagcagaatgaaattgaaaaccacactgaacggccagaccttcgccttccgcgacatcagggatgtcctggccaaggccaacgagcccaaggccgccgaccggcttcagggcgtggccgccgaaaccgtgacggagcgggtggcggccaagatcgtcctgtccgagctgacggtgggcgagctgaccgagaatcccaccgtcccctatgaaaaggacgaggtgacccgggtcaatctcgacggactcaaccagcccacctaccagcgtttcaagggcatgaccatcggcgagctgcgggagtggattctggaccacaaaactacgggggacgacctggtacgcagctgccgggccttcaccggcgaggtagcggcggccgtggccaagctcatgtccgccatggatctggtctacggcgccagcaaaattcaccacatcacccgctgcaacaccaccatcggccagccgggcgtgctggccttccgcaaccagcccaacagccccaccgacgaccccgaggagatcctgatccagatgatggagggcgtctcctacggctgcggcgacgcctgcatgggcatcaaccctgtggaaaacaatgtggagagcactcggcgtatcgcggatgcggtctacagctttatctgccgcaacgacatccccacccaactggtggttctctcccacatgaccacccagatggacgccattcggaagggcgcgcctttgagcatgattttccagtccatcgccggcacagaggccgccaacaacgacttcggcgtgagccgccagctctgtacggaggcctacgaactggcctgccagcacgccctgagcaccggccccaacctgctctattttgagaccggccagggctccgaggtgtccatcggcgccgactgcggggtcgacgagatgaccctggaggcccgtacctacggctttggccgctttttccgccccttcatggtgaacaacgtgtccggcttcatcgggccggaaaccctctacgacggcaaggagatgatccgggccagcctggaggatcacttcatgggcaagctgatgggcctgcccatgggcatggccccctgctacaccaaccacacctccattacccaggacgagcaggagatggccaccatgctgctcaacgccgcgggggccaactactacatcggggtgccggtcaacgacgatattatgctctcctaccaggacaccagctaccacgacaacgccaccctgcgggagctctccggccgtctgcccgcgccggagttccaccagtggatgatgaagcggggcctgattgacgaaaagggtgtcctgaccgagctggccggcgacgcctccattttcctacagtgagagggagggaactgatatgaatgaaacccaactgagagagctcatcctgaaagccatctccgaggcagtgggcgataccgccggcgcacagtccgccgctcccgtccccccggcctccggcgcggtggagagcggagaggtccgcgacctgtccgccgtagatttccgccagattatcgacgtgcccacccccgctaacccggaggagttccgccgcatgcgctccaaaacggtggcccgcatcggcgtgtggcgagccgggccccgttgccgcaccaacacctacctgcggttccgggcggatcacgcggccgccatggacgccgtgtttaccgacgtgccggagcgtctgctggaagagatgggcctgttcaccgtgcagaccctctgtgagaccaaggacatgtaccttacccggccggatctgggccgccgcttctctcaggagactctggccgagctccagcagcgctgcaagcgcaatcccgacgtgcagctcgtggtgtccgacggcctgtccagcacctcagtgtccgccaacctccgggacatcctgcccgccatccttcaagggctgagcagcacgggggtcagcgtgggcacccccttcttcatcaagtacggccgtgtgggagccatggatgccgtcaccgaggccttgggctccaaggtcaccgtgatcctcctgggcgagcgccccggcctggccaccggcgagtccatgagcgcctacatgacctacggcggctatgtgggcatccctgaggccagccgcaccgtagtctccaacatccaccgcggcggcaccaaccccgccgaggcgggcgcgttcattgccgagctgtgcgggcgcatgctgaaggagaaggcctccggcctggctctcaaactgtaaacgcggcccggccggaatctgcggctcctcttccggcgggctcggcatcgcactggggggctctccagccaattcctaaacacgggaattgaccctgctgcgattcaccttttgtctctcagcatgccatttctgccccaaaggactccttcaatccgaatattctgaatattttctacgcttatctgtaatgctgttcaggtacaggccatccgctcacctttcgcacactccctgcacgaagtaaagactccatcacccgcagcttccacagccctccccccgttacaggtcgtcgcaagggacatatatggaacaaaagctccgccgtttccacaggaaaccggcggagcttttgttttgcagcttctgccgtgggaaggggcaggtgcatcactgtgcaccgctcctctatcacacagtcaatctgtattcggcaaatggaaccgttctatccatctgcgggcagcccctgccatcggagcttctcaaccagagaaatccgtccctttacaagggcggatttcacttcaggcccaaaatagcacgagcctcctccggggtagccagcaccctgccgaactcggcggccacccgcttcacccggccgataaactgctggctgccctgggccaatatccccttattgtaatagacattgtcctccagaccgacccggatattaccgcccatcgccaaggcggccagggtaatctcatttgcaccccggccgattccaaaggtactccaggtgcagttctcgggcagatggttgaccaggtagaccaagctctccgtggtggcctccatgccgcccggcgcaccgaggcagagctggaaatgggccggtgcatcgaggacgcccgttttcaaatagtgctttgcggtgttgagcatgcccatgtcgaagacctcaatctccggcttgactccggcggcgcgcatctcctggccgcacagttccaggaacttgggttcgttcataaataccacactgtgaagccagttcatcgtacccgcgtcaaaagacgccatctcgggtctgagctcccggaaggggcggatacgctcctcccaggagaacccctgtcctccggaggaggtcaggttgagcagcaccgggcagccagtggcgcggatcaggcccaccgcctcttcaaatttgtcaaagcgcatgctccccgcgtcgttgtcgtccctgacatgtatatgtaccatggcggcccctgcctcgtagcagcgcagcgctgcctcggcaatctcctttggctgggtcggaagataagggttatcctgcttggtggtgaccgcgccggtgagggcggcggtgacaatcaccttattgctgtcattcaaacgcctggttgtggtcatgcggtttccctctttctaatccaagttttcaattaccactgccgtccccatgacgccggcgcaggggggcaagccgtaccgcagcccgcggctcctgagctcatacagcagtgtaatcacaatgcgggaaccggtggcgtccaccgggtgccccagggagattccccgccgttgacgttcaggccattagagccggcccagcgcgcgggacacctgaatcaggccgcgggtcaacgtctcattggatgctttgacctgcccgggactccagagctggaagccctctcccgttttaaagcccagttttccctcgtccatgagctgtaccatcagcttggagggctcggcggagctctcaatgtggggaaataagtacttgtgaatggagtaggtgaggtccagccctccgcggtcgatcacctccatggggccagagacccccaggcgcataccgaatccgtacttgatggcgtcgtccacatccccggcttcggcgatcccattttccacgatagagatcgcttcgcggaaaagcgcgtgctgcatccggttggccaggaagcccggtacatcctttttgacgaggacgggctttttgcccgcctcctccattagctgaaatacggcggccaccgtctcctcggagacatatttggtacggatcacctccaccaatggcacgaggtaggcgggattccagaaatgggtaccgatgatgcgctccttatggacggccttcccggcaatctccgtcacgctgatggcggacgtattggtggtcaggaccgtcgagagggggcagagggcgtccagcttctgaaagtagtcctgtttgactgccagatcctccacaatgcactcaatgacaacatcggcaaacgccgcagcctcctcaagagactcggtccaactgacccggtccaggatggcggggatcgccccgccatcctgcactccttcctcccggaggatattcagattggcctccatggtctctctgggccgggcgcgcaccttatcgtcatacacatagatgagttttacctcatggccagcctgagcaaacatctgtgcaatgccgattcccatggtgccggcacccagaagcgcaattttcttcttgtctgccatcatggcctccaattacctttctgttcggctgcggatcaatatacgccgtatttatacacccggtcgggaacatccttattgatatggtcctcgtcggtgatggccacggcgcggacgatggtgccgtcgcccatataccagcgcagcgggaaggcacagaacatgaagcgctgtcccttcaccttctcgatgtcgccgcccaggttctcaatacccatgacgttgttgcccagcaggatggtatgcaccggctcccactcggggtagtcctcgatgggctcatgaccaaactccttcttgtactcgtccacgatgcgggggacgtaggggccggggccgtgctgggccgcgtaggtatagaggatgtggtccagcgcctgcagatcgaagcccacgcccttgaccttgtggtccaccagccagtgggcgccctcgatggacatgccgggggagtacatgaagtagtcgtcgttctcgccccagcgctggttcatgccggtgcagatgaggacccagtcgccctcctggatgccgccctccaccttggcggcggccttctcgatgtcctcaacggtgatcagctcccagtgctttttggggatatccaggcagaccgcagggccatagtagttctccagaggcagctcgtgggtataaggagactcgggaatcacgtgggagggggagtcggcgtgggtggagttgtgcatgtggaagtcgttgaaggtctgaagcagacgatagtgcatgggcatgtgctgcacacggtcgatgtggaagtcgccgttggagggccacaggggattgccgcggccgaagggatgggacaggtcgacaagaatggtcttactcatgataataactcctttcaaaatggcagaaatgaggatggagcctgatcaggtaaacatagcgttggggataaaggtggatagtcctggaataaagataaacagcagtgtaatgacgatcataaccgccagatagggcatggagcccttgaatatgcccatgacgtccacatccttgggcgccaccgccttgaccgagtaaacgcacaggcccacaggcggtgtcagtccgcccatatgaagggcgagaattgccaccaggtcaaactgcatggggtcaatcccgagcgccacggcggcggggtagaacacggggatggtcagggcgatgctggagtaggcatccaggaagcagcccagaatcaggaacacgactaccgctgccaccatgaaaacgatggggctcaggtgggcctgggtgaccaggttggtcagcgcctgggccagaccggacacggtcatgaacttggcaaacatgccggagcaggccaggatcagaaacagcatggtcatgttctccaccgtgtccatgatggagcgccagatcttccggaagggggtgcgcttgatgaggcccatgaggaagaacaccagacagccgatcgcgccggcttccgcggagctgcagatgccgaagaagatgccgccgatgatcaccacggccacaattgcgatggggatcaggttcttcagggaaaccagcttttccttccaggtgaagcgctgctccacccgtgggaacagggagggcttgacgatggccgcgatcacggtaaacagagagaagccgatcgccagtgccagaccgggggcgatggcggccatgagcaggcggccgatagagtcgcccgacagggcgccgaaaatgactatcaggatactgggcgggataaactggccgatgttgccggaggcagcgatcaagccataggtcagattggtattgtagccgtaccggcgcatctccggcgcagcgatctttgcgaacacggagccggtgaccagcgcggagccgttcagcgtgccgaaggcggtgcatcccagcgtggtagccacgcccaggccgccgggaatgcggcccagccacttggccagcgtgtcgtagcactctgtactgattccgattccggttgccagcatgcccatcaaaataaacagcgggatgactgcataatcaaaggttgcaattccgctgtaggcctgaatgccgaccatggccaccgccttgggcaggttcaggcaggcgaccagcccgaaaaagcccacggttcccagcgccaccgcaatgtgtactcccatcaggaccagcacgatcagggtgaccatgccgaccagggccaaaatgattccgccttccatttagccgtcaccatccttttccgcgttctgcgtcccttccacaccaaacgcgcccagctcatcctcggaggggagctcggatttgatcaggatggggtccacctggtttggcctggcgattccgacggcgcagtataccgtcatgaacgcaccctgaatggccagcagcagccagcccaggaaacagccgaactttccgatgaatacatacaccgtcacggcggccaccgacttctctttgatcagccaggaggcccagaactggtcccaggacgctttgatcatgacaacaaacaggattgtggccagcaggtagatgaaaaagctgaagatgtgcttgatccggccgtgcagcctgtcgtacacggcgccaagctgcatgtgctgtcccttcagcaaagtgtagcccatgccggcataggccacccaggccatcagcatggtaacgatctctgtcgtcccctggatcggcgaattgaacgcatagcgcatgaacacatcgcagcagatgagcaccatgttaaacagcatcaccccggcggagacccagccgaagagcttcatcaagagctcaggcttttcataaaacgcggatagtttcattgactttgacatgccgttcctcctttatctgtcctctctgccgactcccgcacgcacaggagccggcggtacaggggcttactgtatatagggagtggtatcaaagtgccactcataacccagctcttccccggcctgcaggtaggcggacataatgccagcgccgtcatagccaagggctgtgacctcatcaatccaggtctggagggtgtcctgatagccgagggctgtctcagcccactcggccttggcttcgtcggaaagggtggaaatcgtaacgccgttgtcgagcatctcctgttcccagccgtccatctcgctctgctgccagtcctggaactcggccatggcctcgtcggcgcactcctggaagagctgctgggtcttctcgtccaaactctcccacatgtccttgttgaagcagagcacattgttattgcgcgcgcccaggccgacctgaaggcagtagtcttccacctcatagagcttgtagttgcagtagatgctgtcatagacgaaggagccggaggcaacaccggtcttgatggtctggtatagatcggccgccgcagcgttgacagggacagcgccgatggattggaaccaggggatgtagtacacgccgcccaaagtgatttttttcccctttagctgtgcgagttcttcaataggccccttggaatagagtttgtagggctcattgcccttccagcccagacataccacgttgtttttttcgtactcctcataaaactcagggtacgcctcggacactttatacattaattttgcagccaggacggggtcatcaggggcaaagggcacgcagtaggtgatctgcgacaaaggcaggttgctgggcgtataaagggtgcacaccgtacccaggtcggcaattccggagctgagcgtattcaggttgtcggtggctttgcccagcagattgtcgtaaaagaccttgaatgtaatggcgccgccggagcgctcagtaaccagattggtgaagatctcaatttcgtgggccgatgtcttgtcgtgggagtcgatggcggccacaataaactcccgtttggggtagccggactccgtgatctctcccgtggacgggttgtccgcatttccacaggcggtcagcgagagtcccagaagcatcgcacctaatacagcgcaggcaattttctttttcatgaaacagatatccctcccatttcaaatttcatgtcagccggtgcggccatcagttcacgccgtatttgcaaacacggtcagggacgtttcgattgatgtgctcctcatccgtaatggcggccatacgaatcatcgtgccatcccccatataccagcgcagcgggaaggccgcaatggtaaagcgctggcccggttactttttcaatatcacctcctgcattctccactcccatcacgttgttgcccagcagaatgatgtgcaccggttcccactctggaaaatcctcaattggcggatggccgaacggttcggtgtactccttctcctcggtattgattgagccaatgccaaatagaaccgcttgacatcctatttctatagcaacccgcgtgccaagcagcaaaaaagcgggctgctcctttttctgcttacggctccaagggatcggcggtttgcttcccggggcgggacatttgtgggatatcagcatattgttgcggaactgcgcatctgtgttgcgcacctgaaacaattgcacttttgacaatattcgtaattatggtacaataatagggacgaaaaagcgacgttttccgtggaggtgcttcaatggacagacatatacggcttgacacgatcgcagaaaagttagaggcgctctgccggcaggacgggccggtatccgggcaggccgcccaggtactgtctgaagcagtggatgaactgcatgcatttcagagggaaaatctggacttccatgagattgtggagcatgtggaccacagcattttcgtcaccgacggggaaggcaatgtgctgtatgtcaaccctgcttacagtcagaacaccaacgtccagccggaggatgttttgggccgaaacgtattcgatatcgtgcaggagggcagaatcttcaccgggggtgccagttgcgatgtcattcagaaccggaagcgagtctttcggctctccacaacctataagacagacccgcccttgatgggctataccgtcggcgttcccgtctttaacagggatggctccctatccaaggtggtggtcagcagccgtcccctgtccaccctgaagctgctgcagggcgattttgagcagttcctccacaatcttgaggaaatcaggaagcgggagcctgtgtcctccgtcaatgaaaacagcagcaccctggaggcccgccccatgattgggcactccaaggcgctgaatggtatctgggagaaaatccggcatgtagcggcttccgatgccaccgtgcttattaccggcgagtccggtgtaggcaaggaggtggtcgcagacgaggtataccgccacagtctgcgcaacaaccgcccctacattaaagtaaattgcgccgcgatccccgccagcctgctggagtcagagctgttcggctatgataagggcgccttctccggcgccagcgccggcggtaaggccggcctctttgaactggcggacggcggcaccctgctgctggatgagatcggcgacctccccctggatctccaggccaagctgctgcgcgccatccagaaccgggagatcacccgggttggcagtaccaaggcaaggcgtctggacatccgttttctctccctgaccaacagcaacctgcgggaaaaggtcgccgcagggaccttccgcagcgaccttttctaccggctcaacgttattcccatccagatccccccgctaagagcgcgcccagaggatattcccgaactggtggaacacttcttggaaatctaccgcaggaaatatcagcggtccatcacgctcacgcccaagtcaatggacattctcacacgctatcgctggcccggcaatgtgcgggagctggaaaacgcattggagtatctggcgctgtgctgtcccgagggcgatgtggtacaggagagcgttgttctggatctgctgcggcaggacactgtggacgaggcgttgcagccggtatctaccctgggagatgccgtttcacattatgaaaaaaccttgattgagcaggcgcttcgaaacaccaacagcatgcggtcggccgccgaagttctgggcgtgaatgtctccaccatctcccgcaaaattaagcagtataatattcatctgccctaaagttccctctgttccgctccggcacagagcttcagttcgtacactttaccagattgatcgccgtgctataaaagggaaacccgccagaatccgtagtttctggcgggtttatcgtttggtgaatcggtcgctgctcccttggttatgaaacacagttgacggccgcggccctaatttcaatggctttcagtttgattcgtaccgccgcaggccgattcagcgcatcaaggagcagcggaacgatacaagagcccgttaatcacattgcgcatttttcttcagtaatcggctcttccccacgcggtacttcacagccggatacaaggccccgttcagcggaaccaaatttctcggctataatcggttaaatactctgcgccatgggccgttacaaggattgtatccgtcagccggggcccgccgatattggggacatagatgctgggcaggagcaagtcaaccaccatgtttttttcaatggggaccgcgcttccctttgcgatgatgggatagaactctgactgccggatacccacaccgtagccaatgtgttccatcacccagtgttccccgtatccggctttctccacacagtcggcagcagcctgatagagcgctccgcaggtcacgccggggcgcagtctggcgactgcggtttcctgagccctccggagcacccggtagatctccacacatgcctccggcggcgtacccagaaagaccgtacggcacatttttgcggtgtagccctccaccgacgctcccaaatgaatcaccaccggtgcgttatcctccagcaacgcagcgccggcatagggatgcttctgcatctgtcggctatgggtcagcacctgcatccggaaaggggagccctgacttccagctttccccattgcatactccgcctcaaccaacacatcccgttccgaaatccccgctctgacaactgatagtgccgcatccattccggccttcaatgccttggatgccgcacggatgcgccaaatctcctccgggcacttgatgctgcgcagttggtagcagaccgccgcaatatcctccaccttcatctgcggcacggcctcccggaggcactggtagtccttcaggctgataaaatagcgtgtaaatcccacacggggccgctccaatcccagcttgtggagccatttagccgccatggtgctttgagtgtccgccggaaataggtagcctgtcacctttaagccgctctcccggcgcatgtgctccgcctccatccagagacaaaacagctccgccgtcccgtttgagggaacgcaaagcactcctccctccagatccgaaatccccgcgaagtagatcagattttcccggtcatagatcagggcagcgtccagtccacgctccctcagcttatcctgaagcgctgcaatacggcagggaatatactgtttcatatggcgttttcctcctcaaagtgccgttaccgccggatgtttctgtagagcaactggtggtgtccgcatgctgtcccttctccagtatacctatagatagatatacctgaggctcaaccggcctgttcaaccaccgccgaatccgtcttaaagtctctccggtcacatattgcagagacaaccacgcccgccaccagtgcccagaaagctgaaccaatccccaaaaatgagaggccagaggcgccaacgcatagcgcaaagaaagctcccgttttgtatttcaaggtgccgaatccctcattgaatgcctgaatcagtacattaagcatggccagacctgccagcacgttaaccagttcagagggaataaaagatacaaatgcaattgtaaaagaacccaccagcccaaacgctgcgaatgtgacgccattccaaaaagaggctgcatagcgtccctccttgggcccagcctcctccgatgcgcagatagcggtcataggccctgcaatatttgcattgtgcgcacccactaggccggaaatgataccgccgataccggatgctactgtcattgcattggccggtacattgtagccttgggcctttaaaacgcccattgcctgcgcgttttctgctccaactaccaaggctgcaagcggcagggagcatgagagaatcaaattggggttaaactgcggaacaacaagcatagggggagtatataccagttctcctacctcaccggcaaaggagtttgtgacaatcgccgcaatgactcctaccacgagagccgccaagactccaggaaaccctttgattacgcgtggtaccaacaaaaatgccaacacggccaacccgcatacgatgggcaaggtatttatacccgttacgatttgtgtaccaaacttgagcatgcatccgccaatcattcccataacgattggcagcggaagccagcgcatcacttttcctattaagcccgtcacgcctaaaagcaacacaatcacgccagcgatgacaaatgcgccagccgcctcctgaaaactatagcctgccagtgctgtccccatcaatgtggcacctggtatggaaaatgctccggatatgggcatcttatagtagagcgacataattgcccccaataatccgccgaaaacatatattccaaaaatccaggacacagtctctgccgtggtaaagccagccgcctcggaggccgcaatcgtcacgagacaaggacctgtgcagccaaaaatagtagaaataatcgcgctggaaagggtcgacccgttggtatatttgagcaagtcctttgctcccgctctaaatccgcatcccttttcaaacagtcggaaaccgctctttttttcagtagtgtctgcacccatgctgttttccctcttttcttctcttcaatatccagtacggtccagcggccataaggcacatatgccaccgtagcgtttgggccgtacctctccagcaggcggtaaataccttttggagatctactgatccatgggctgccaagcccatatcatgggcaattttcagatcacagttacagggaatgtgctctcagcacactacaacgtaacacactttgtaccaggccgggactctggagcggcaggatgacacccaactgttctgcacctttaaaaggtgcctggacagttgccgttataaccctcattcctacagcagagtaccatgtcctttccatgttccgagttgtctgcttactcatttttgagccaggctcttaagaatggagacatccacgccccgctggcggaaccacttgggcatgagaatttcgtccacctctttgctgacctccggcgcctttgtgatgagaagatccgccagggactctgagcagttcagcccgcccatggcaccgtcaaaaatgatcaccttatccgtgcctgtcgtcttataggcgaagtccatggcgctctccgtagtcttggctaccaccgcgtgtgacatatactcgatgttcataggctccatgtcgaacaggtcagcctgctcctgccccaccaccaccgtgggaatgtggtcggagaaaaaggcggaggggtatccggtccacgcgtagttgtgcacgcacatcttgatggccgggttcagcggcgggatatcgttcaggatcggcttgccgtttctcttgtaaaaggcctcagtgtaccaggtatagggcggcaggggggtgccctccatgtcgtagagatcctggttggccccagtgaagttggcgtagatgacgccggcggagaacacgtatggtaccgggcaggggaagtccagtacggcgatgcactcgtcaatcttgccgaatagggtcatcacctttccataaagctggcagccaacaaaggtggcccggtcgttgacggcatagaggtcgttatccgcatctacaccgatgacgccatggggacccacgttcaggaaggacgcaaaggcaaatttgctctggacaaagggactctcaaagatggcccgggcggtgaagttggcggcccgggggcccaggttctgatggtaagtggagcgggtctcgatgcgggcataggacatgccgaagggcttgaccgctttgtccacctgccggtggaagtggacctcccgcacatcggtgtggtggcagtggacaatccagtcggcgtcgtagacagccttgataccgtagagggtacccacctccgtctcgatagggatgccctcatcaataggggccacgcccttggtcttgccggggccgaagtactcgtccagctgatagcgcctgatatactcctccgtctcccggaagcgcatacccacgccggcccgcaggcgcacgtccctacagccggtcttttcgatgatggcatcccgggtggccttgatcaggatggcgtagggctggccgcccagcagggtgaagccgtggtgagaagccaggatgttgaccgactggccgggcttgatgaagctcatgtccaccttccgcagctcctccatggccacctggtaaagcttgtccagtgcatcgtgcccgcccggatagatcaccgggggcagctctggaaacagctcggccaaccggagggaacacatgccgggcagttcggccacgcgccttttcaccagggatggatcaataccatactgggagggtttagcggcaatgggcataatgggggcgtgcttcaaattctcgttgcacatgggattacctcctctcctaaatctcctgattagtggcggccacctggtccagcagcttacggtcctcgtcaaaatagaaacctcggctggcatatttctgcttgaccttctccggcatggtccaggcggtgaccgtctctccataccattgccagccgtccgggttgggtttgggctggatgccggcggcctccagcagacgtagaatgggctggatgcactcgatggtacaaccggtacggattccggtgcgggacgagatttcctccggcgtgtccgctccatccagaatggcagcggccacttcctccgcccggacgccgacgcaatagcacaaaacctgctgtggatggaagtgggccttttcacacagggcgaggatcttcgccccatcaaaccggctcacatccacaccaaccgtgaagggctcttcccgcttgaccatggtaatcgcatggaatgggcatcggtccgcacagttggcacacccccggcagtcgggttcctccaccgccgccttccgattggtgacatgaatggcatagacgggacagactttttcgcagacccggcatccacggcagatgtcgggggccacatgcgccatgatggttacccgcttcatatgctggtctctcctttttcaattcgattttgccactgtcctttcgacagattcagcactctgtttttgccagagagagggcatgggccacgtcgataatcatgtcctcctggccgcctaccatgccgcgtctgcccagctccaccaaaatatcccggggattcaggtgaaatttttctgcggcacggtaggtatgcagcagaaagctggaatacacgcccgcatagcccagcatgagcggcgcgctcttgatgatctgcggccgctgcatgataggctccaccacgttttccgccagatccatatagctgtagaagtccaggccggtcgagtagcccagccgctggaataccccggccaccacctctgcctgggcattcccggcgcccgcgccaagcccccggcaggttacatcaatgtaatccgcgccgcactccgccgcagtcagcgcgttggccaccgccagccccagattgttgtgggcatggaagcccacaggaatgggcagcttctccaccagcagagaaatccttgcccgcacatcatccggggtcatatagcctgcggaatcggcaatgttgacgtactcagcgcctgcgtccacaaaaatctgtgcctgttccagtatcttttccggaggcgccatatgggccatcatcaaaaagcctaccggcatcatgccgagctctcgggcggccttcagatgttggatggcaatgtccgcttcggtcacatgggtagccacacgcacgacctgtgccccattggccctggcctccttcagatcctcaatggtccccacgcctggcagcagcaaaacgcccagcctggcgcgcctgaccacctggctggccgcccggatcagctccatctccggcgtggcggaaaatccgtaattgatggaggagccggccaggccatctccgtgggagagttcgatgatgtccactcccaccttgtccaacccggaggcaatggcggtcacctgctccaccgtgtagctgtggctcacagcgtggctgccgtcccgcagggtagtatccacaatatgtatttttctgttcttgtccagactcatggctcacttgccctccttccgcatcctggcggccaccttttccgcggcggccaccgcagcagcgttgatgatatcgaggtttccggagtatttgggcagaaaatctccagccccctccacctgcacaatcaccgtcaccttattgccatctacaatgggcggtacgcgcagagaatagccgggcacataggcctgtacctccctgacgatctggttgaccgactccacaatggccctttcgtccgggtttttcacaatggagtagatcgtgttggacatcatcaggggcggctccgccgggttcaggacgataatggccttggagcggtctgctccgcccaccacatggagggctttcgaggtggtctgggtaaactcgtcgatattggcccgtgtgccagggccggcgcttttggaggagatacaggctacaatctccgtatactcagagtccgccgcccgattgatggcgtaagcgatgggaatcgtggcctggcctccgcacgtgaccatgttgtagttgtccgtattcagctcctgcaaatggtccaggttaacacagggcaccacaaaggggcctaccgccgcaggggtcatatcaaacacaattttgcccgcctctctgaggatgggggcgtgcttcatatgtgcagcggctcccgtagcgtcaaagacaatcccgatttccgggtccctcgccactgcctcaacgccttcgatggaggtctgaaaccccaggcccgcagcccgccggattccctccgactccacgatgcccgtcatggtcttcatctccaggttccggctgcgcattaccttatacattaggtccgtgccaatattgccgggcccgatgatcccaactttgactctctccatgctgatctccttttctggttttccatctatttgtcatacacgccgcccgacggcgtggaatggcccggttcatccacaaagcgcacagtgacgctgcccatcccctggaagctgaccgtaaacacgtctcccgccttggccgggaccgccgcagtcaccgcacctgccatgacgatggagcccgccttgagggagatgccgaattgccccagcttgttggccagccatgccacagaggccgctgggttgccccacacctccgccgtggtacccgacgacaccagcaccccgttctgctccagagtcatgccggtcaggcgcatgtccaccgcaccaataggcatcatccgtccccccagcataaaccgtgcggaagagccgttgtccgctatggtgtcgggcagcctgatcttccagtccttaatgcgggaatccacaatctcaatggaaggggtcacccattcggtggcgtcgtacacatccgccacggtgatcccgggcccctggagggacttgcccaggcagaaggacagctcgccctccaccttgggctggatcagccctgacaccaagcagggctcccgctccagcagcagcatattttcaaacaggtggccgtaatccggctcatgcacatggagcaaccgctgcattcccacgctggtcaggccgatcttcatgcccaccacccgttccccggcggcctcccgccggcggacattctccaactggacggcataggcatcctcaaccgtcatctccggatgggtctgcgtgagcatgtcaatctggtaccgcccctgctccgcctcccacagcatctgcgcagcctgtttatggtccatattcttcatcctttctcctgtccacggttgtgatggtgaggctgccccatccctttccgcctccacttgtctgccagcgccgccgccagccggtccgccagagtctccttatcccagttttcctccaggccccggagcagaaccggagctgcgcacattacctcgtcgtgaggcccgggcagcgctaccatacggctggggcccactacgcccacaccgatgcggacgccatccttcacatgccggccggttccctgctgaaactttacaatatacggggttgccgccgtgggatccatgcggcagaccccctctaccgagtggtccttgtcctccgcccctacgccgccggtggtaacaatcaggccaaacccccgggacaatgcgtcatccagtttctccaccacatcctccacattatcctccatgacctcccccactgttacgtaatagccccgctcttccagctcatgcttgagaaacggggtgttggtgtcctgaatcatcccctgttttagctcaaatccagtgggaaaaacaattgcccgcctggacaccttttcctgaatttcccgcgtcatattggagactctgtccaatacggcttcaggctcctccacatccgcacagatgaggcccagaatcccgttggagtgaatataggatttatctgtcaggcacaccccgggcagggcggccagcgccgacaaaattgcccgctcctttcccataatcccagcctgcgggacattcctttccagcacgtcaaaggtgatgtggcggggccgcacatccactaccatcacctttcccttgtccaggccaagctgctccgccaccgcgtccgccatatcgctcagattggcgttggccagtgtaatttcattgacccagagctccgtcttttccagcaggttcaatcccatgcttcaacactcctccctcatcacatccagcttccagtccagcagcggggcatctacaatttctttcccaatgcagaggatgtcggcccgctccgacagctccggaatatccgtcagctttacattgccggcaaatgccacttttatgtgtccccgacagcccatagccgccagttcggacaggcagcattccagatcctcccgcgctccggtatccaccatcaggatatcagctcctccccggacagcagcctgcgtctcccaggcaaccgtggcgctctctccccggagctgcaccacctttgtatactcgtggaaagatgcacaggcggccaacgcctgggggatggagcccaacatacgaatatagtttttatccagatagatcatcggctgctctgcaatccggcagttggctccacccgtcaaaatagcaccgcgtacaagctccttgatttgtggcggcatctttttccaggagccggacacaatttcggcgcgtccatccgccatcaggaccgctgtacgggccgcagtagcaatcccgcttgccttcgccagggcgccgatcatgcgctcctccgccagggccacctgcttggccgccgcaaccagagtgccgatgcgctccccgtgcatcagttcctctccatccgccttgcagagctccagttcgatacccagctcatccgcctgggcctttgcagcttccgtgccggccaatacgccggcgcgctctgcggtcagagctgcccggaaccgtcttccgtatatgctccgaaaaagatcatcccggatatctctcatatccctctccttttcgttattgccgaaccatgttcgtaatgatagctatttttgaagggaaccgttcgttcccttcaaaatattcatgctatttgttatttaatgtacccgaggcgctccgatgtctgcttagcataatataggacatcccgaacggcctgctcccaatccagatcccacattcttccgtatggaaaggacatcgaaatcgccatctgaggctggcgcttgtgattgaaaatcggagctgcgatacagtgaaggccgggctcgatctcttcatcgtctaccgcataaccccgctcccgtacctgctccagctccttcagcagcccatctcctgtcgtaatggtatgctctgtcatctttatcaggggcctggacaggacatatttttccatatactcctcgggcagaaaagccaaaatcgctttgcctacgcccgtgcaatacatgggggcccgcttcccaatctgtgagtagacaacaaccgagctgttgttatccactttgtcaatgtagatgatctctccctcagaatgggtagccaggtggaccgtggttcggtatttgtccgccagcagctggcaatagggccgcgcctccatgcggacatccatgcgggactgaacaagatttcccagctcaaaaagcttgagacccaggcggtattttttgttctctgtctgttccaagtatccaaaagccgtcaatgtattgaccagtccgtatgtcgtactcttggatagatccatccgttctgcaatttcagagatacctagttccgtatcatttgcgaagcaggagatcattgtaagggcacgtgcgaccgattgtacaattacgcctctcttttctttcccttccattgtctatcacgtctctttctgcttctgattataggtccaccgcatttccttgtcaacatttttcgttattacaaaacgatatttgtttatatagaacaattatccgcctgcattttttaccgaccgataaaaaaaactggctttcccgcccactgcccattgctgccccgactttgtatcgctgaaatacacactggtttccatctctgcctaacccgtcgaaatcttgtgttcaggcgcgtgcaatgccctgctctctggcctcctgtgcgacggcatgggccacggtgtcggccacggacttgtccagggcggagggcaagatgtagtcggcgctgagctgctcgtcggtcaccagggcggccagggctctggccgcgcggattttcatcccctcggtgatctcccgggcccgcacggccagcgcgcccttgaagatgccggggaagaccatgacgttgttgatctggttgggaaaatcgctgcgcccggtgcccaccaccgccgcgccgccccgcttcgcctcgtccggcatgatctccggggtggggttggccatggcgaacacgatgccgtccttcatggtggacaccatctccgccgtcaccaggttgggccgggacacgcccacgaaggcgtccgccccccgcagggcgtcggccagagcgccgtgctcgtgattccggttggagatgtgggagatctcctcctgtccggcgttgagcccctcatccccctcgcagatgatgccgttgatgtcgcacatgacgatattgccgaagcccatggagatgagcagcttgccgatggcgatgccggcggcgccggccccgttgatgacgaccttcatctgccccatctgcttgccggtcacccgcatggcgttgagcagggcggcggccaccacgatggcggtgccgtgctggtcgtcgtggaacacggggatgtcgcacacctccttcaggcggcgctccacctcgaagcagcggggggcggcgatgtcctccaggttgatgccgccgaagctcttggagatcagggcgatggtctccaccagcttgtccacgtccttggtgtccacacagatggggaaggcgtccaccccgccgaactccttgaagagggcgcacttgccctccatcaccggcataccggcggccgggccgatgtcccccaggcccagcaccgcggagccgtcggtgatcaccgccaccagattgctccggcgggtgagggtaaaggacttctcatagtcctttgcaatttcccggcagggctcggccacgccgggggtatacagaagggacaggtcgtcccgggtctcgatgtgcctgcgggccaccacttcgatcttcccccgcagttcctcgtgcagcttgagggattcctgattgacgtccatagtacgtttttcttcctttctgcggcccgctcagaccatctcttcggggtggaacacctcgtcgaaccgctcggcggtgaggaagcccaggctgacgcaggcctccttgagagagatgtgctcggcgtgggccttcttggcggtcttggccgcgttgtcatagccaatgtaggggttgagggcggtgaccagcatgagggagttgtgcaggttgtggcggcatttctcccggttggccgtgatgcccacggcgcagtggtcgttaaaggagcggatgcagtcggtgagcagccgcgcggactggaggaagttgtagatgcacaccggcatgaacacgttcagctcgaagttgccctgggaggccgccaggcccaccgccacgtcgttggccatcacctgtaccgccaccatggtcaccgcctcgcactgggtggggttgaccttgccgggcatgatggaggagccgggctcgttctccgggatctggatctcccccaggccgcaccgggggccggaggccagccagcgcacgtcgttggcgattttcatcagatccgccgccagggccttgagcgccccgtgggcgaacaccagctcgtccttactggtgagggcgtggaacttgttgggggccgtgacaaagggcttgcccgtcagctccgataccgcctcggccacggccgtgtcaaagcccttgggggcgttgagcccggtgcccacggcggtcccacccagggccagctcccgcaggccgggcagcgccagctccaccatcgccctgtccttctccaggctggtccgccagccgctgatctcctgggccagggtaatgggcaccgcgtcctgcaggtgggtccgcccgctcttcaccacgtccccgttctccccctccagccgtcggaaggtctccaccagcccgtcaatggccggcagcagcttgtcctccagcgccaccgccgccgcaatgtgcatggccgtggggaaggtgtcgttggagctctgggacatgttcacgtggtcgttggggtggagcagcttcttccccgccagctcgttgccccggttggccaccacctcgttcacgttcatgttggactgggtgccgctgcccgtctgccacaccaccagcgggaagtgcccgtccagcttccccgccaccacctcgtcgcaggcccggctgatcaggcccagcctttcatcgtccagcttccccagcctgtggttggccagcgccgccgcctttttcagaatcccgaaggcccgcacaatctcctccggcatcttctccgtgccgatctggaagttctgatagctccgctgggtctgcgcaccccagtagcggtccgcggggacctccatctctcccatcgagtcccgttctatccggtagtccatatgtggctctcctttccttattcgctcattttagattatacgggatgtgtcaaatcccccggcccagaacgagccgggggattcgggtcatcggagaatgggaacggtctggcgcatgagattggcaacggcatcatcctttagcttccagagggtcctgcataacacacgcgcctgctcctcacccaataccgggcaggtacagcgcaggaatttctcctccagcgcctgatccgaaatgggatctgtccggtgtcccacgggataaatgcgctctgtatggtactctgtgccatccaatagggtgacggatacgaaggcaggtcctacccccatatccactgggagcgcatcataccgctccgcatggcaaagatgagtggcttttataatccgttggatatcgggccggaagataatcttctctgtataattgtccggcatgttgtccaacccgctcaaatagagggccacctgaaacccaacgctgaacttggcctcatctccggttctgggttcgggcgtcaccagctcacgcagagcggccgcactcagttccacccggatggaggcgatgtcctctggttgaaaatgatgtacttgcgccaaatcaacaaaggcatccactgcacggtgggtactgctacaggagggatactgtttaatcgcaaacccgggggtgcagacatcgtatcggtttcccagggtcttgtaccagtctgaaccaaacgggtcaaagcgaagcccggaatactcgtagaggtagccctcccggccgtccagggcggaggaggaggcggtacagccttcccgggccagacaggccgccagaagtccatccgcagccgccttgccgatatgaagcgacttggtgtccgtcccgaagttctcccgcacaccagccgccatggaggcggcaattcccaggcagtttacaagctccttttccttcagtttcaaaagatacgcggcgcccgcggcggctccaacaataccggtaacactgctggcatgccatccccgctcgtggagggcgtgagcgcaaagacgccccagcttgcactccacctcggtggctacggcgaatgcacgtatcagttcttcgccagggctgttcaattcttcccccagtgccagcagagcgggcagcacagccacggtggggtgccccagattggagctggaggtgtcatccaactccagctcgtggccgctgataccgttcaggaacgccgcatctcgcgcggaaaagcctccgccaattcccgccagagtggctttcccggcccgcggaataacccgcgcagctttttctaccaccccggtacggctgccaaggaccatagcccccacagtatccaagatggaacgggtgcagaggtagacctcctcctcgcccagcggtaccggatgttgaataaagtgtgcaaaggcttctgacagcgtcatgactcctcctccctaattaatgcatcggtcagctcctccaatcggctggaggcccgcttcagtcgatcccctcgggccttccattgactgtccagctccttcagccgtccccctccccactggatcatttcagccacacgtgcaggactggggcctccgataaggctgcggcgttccacattctggacgggatccagagcggcgcgcagcagttcctccggcatgtccacttctaccccaagcgcctccaggcccgcccggtgcaggaggtcccggccaattgcctcacaggggatatgctcctcatgggccagaagcaccagcctgccgaccagcttcttggcggccgcaaaggacaggccctggctgcgtaccagctcgtctgccagctcggtcatggtggaaaagcctttgcgggtcatatccaaagcgcgctcccgatccacctccaaagtgcgtacaatcccctccaggagataggcgctgtccataactctctgcgcgatttcatagtacaggctgaccacaaagccgggctcccgcccattgcctggcgtataggctttcatggtgttgaacatcgtactcagggcgccatagctccattccccggaatagcgaagtgtttccagggccacggggttgcgtttttggggcatgatggtgctgtaggagcagtacttcaaattcaggcgcgagatgcccacctctcccatgttccacagcagcaggctctccgccattcggcccacattctggataaaaatacacatggcgctggccgcctcataggcgaaatccaggctggacgtggcgttcatagagttcagaagcaggccgtcaaagcccagcagctcggcaacccgctcccggttgatgggaaaaccagtcgtggcgatggccgcgccccccatagggctcaggttggtgtggtcgtaggctgccagcaggcgctccagatcgcgggcaaagttttcgaacgcacacagatagaagtgcccaagtgtaaccggctgcgcatgctgggagtggtgtgtatagcccggtataatggtatttttgtgctcctctgcctttcggagcagggtatccatcaggaaggaaaccgcttcacacatatccagcagtgtctttctggtatacatgcgttcaatggtcaagttcatatcattgcgggaacggccggtgtggaactttccgcctacttctatccccagttcctcaatcagccattcctccagattggagaagagatccgttaggcccggccggcggcctgtagcatccggtcccgcggccaggagcttacgcagagccgcagaaatagctctggcctccttgcgggtcaatatgccctgctcccaaagcatgcggacgtgggcaaaatggttttccatctgcatggggaaggaaagcttgtcctcctgaatggtgtcctccgtatgacggttcagaatgaccatatcccggccgtcatatttgctgcgctccgcttctgtcatatcgcaatcatactcctttttctcatgcgttgttacttggactccgcggccttcactccccacagcctgcacgagaggaggtaaaatacgatcagcagagccagggcgaccaccagcataatccagatatttgcattggtgaagcccagaatcaggtaggccacaaagctggccagcgccgcgattcccgcataggggagctgggtacgggtgtgctccagcagatcacatccggcagccattgcggacatcaccgtcgtatcggaaatgggcgagcagtggtcgccaaacaggcagccggacagcaccgcgccaattgtcatggggatggacaccccaaaaccgacggccatattgatgccgatcggaagcaggatcgccatggccccccacgaagtacctgtggcaaaggagataatgacgcccaccaggaacagcagggcgggtaccacatgcggagtgatcagccccagcgtggaatccacaataaactgagaggttccaagatccttgcagacagagcccacgccccaggccaggaccacgacgaccaggacggagcccatcttttgaataccgccgatgaacacgtcgaaggtttccttaaagctcatcaacttctgggccgtaatcataatcatacatacgatagaggccagcagataaccggaggtcagagcaatgcggattttggagccgggaatgttctggaacgggaacccccaactgacaaacatcactaggatggtccccaacaggatcaccaggggcaggatcatattccagggagacaccttcttgtcatcggataccaggatggcctcgtcgtccgcgatgttctgcggcagtcccagacgggcctgctcctccgccttggccatgaatccaaagtcgtgtctgccaaacgccacaattggaatcaggaaaagcgcaagaatggagtaaaattgatagggaatcgccgccatgaaggtggaggcgtcagagccgttgatgccgagcgtttcaaactcggtcgcaataatgctcatgatatagacgccccagccggtgatgggaatcagaatacagactggcgaggaggtggagtccaaaatataggacagctttgccctggatgccttgaggcggtcaaagatgggacggaacatgggccccagaatgaggctgttgccagagtcggaaaagaagatggccagcccgcccagccaggccgccagctgcgcttttactttgctgttgacgctgtttgccacggcctttgcaaatgcccgtgccccgccggatttctcgatcagggctacaaagccgcccacggtcgccatcattacgatcgtctggggattgttgtctgtcgccagatcgacaaacagatagtcgctgaacaggtgctgcagggagagccaggggttggcgcccacttggatcatgatgccgaggaacaggctgattgccagggagagcactacgttgcgggtggcaaaggccagcacgactgccacaacagccggaatgagagacagccagccataattgatgacttcttccataagaacctcctattcttcacgtatgatggttcaggcttccataatgcaccgggttacctccttctttcttttaataatgcaaaccgtgtgccaaataaatttacattatcagggaaattaacagcatctttctcatattacaatcacaggggagcaaaaaatcaatgttataagagcgacaggcgacgaattttcgtcgcctgtcgctctcaatcatgggttatatacggttcaacgtcgccttattgacaattattcgtcttaaatgacgattttttgtcattcgatcattaacccatacttacgaatcttatactgcagcgtggttctcgggatctgcagaagtgccgccgcctccacaattttgccgccacaggacatcaatgcctgcaaaatcagttttttctcatacaagcccatagtttccggcagtgaaagcgttggctccgtattcttctgatgaatttccggaggctccctcatggtcaaataagcgggcaggtgctccagagagagcacgcttccctctcccaaaacattgagtgccgcttcaatggcatgctccaactcccgcacattgccgtgccatctgcaattgctcagaaaaaggatcgtctcctgggccatctgggggaccggccggcctaacaccctgctgtacttataaaggaaatactcggacagcaacgggatatcgtccggccgctggttcaggggtggaatcgccaatgtcacggtgttgaggcgatacagcagatcgggacgcaattctccattccgcaccaactcatcgggtggacagttggaggaggagacgatacgaacgtcaacggcaataggctgtgtacttcccaacggcatgacctgtttttcctgaagcactctcagcagctttgcctggagattgagcggcatggagttaatctcgtccaaatacagagttcccccatccgcctcctgaaaaaggccttttcggttttccgccccggtaaaggcccccttccgggagccaaaaagcagtccttccaaaatactctcgggcagagcggcgcagtttaccgccacaaaaggcttggccttccgatagctggcattgtggagcgaggacgctaccaactccttgccggttcccgtctctccacaaatcaatacagaggatgtgctgttggctacctttccaatcgtctcctttaaacggagcatccctgaattttgggttatgatatcggtcaagctgtagcgggccgcggcactgcggggggcaggcggagtctgactgggcggtacggggtgaatacgattgtcaatatgtgtgatgtctcgtgaaatttccacggcacctacaattttgccccgaaaaataatcggaaaattcagattgttgcataccgttttcctgccctggagattccatgcctcctgattttcaatgtatataatttttccggtatgaagaacctgcagcagcgtgctgtcttccggacttaaagaggggaagagctccagcaagttcttgcccagcgcccactgattatgagccagattctcttcatccgtatagcgtggattaaacctctgctttgcaataattctccccgtgctgtcaatgacggtgacagaatccacatagttcaaattttcactcagccatcgcatggcgatttccttggtgtccatgccttcagcctcctctgctttgcaaataaacagttctgctcctttcccgctatcatagcatagacccaacacagcggcaagcctcacgcctgcacttctgtcaacttcacctattccaccgatggtatgtcagccatcagaccatacaagtaccggtatggttggccgcggaggcgcttttggactccggatgcgtcgcgcatatgtgggaatctgaaaagaaaaagaaaccccgccggaacccaaggattccggcggggttctggtctcaacgaaaacccactcactgacaggcgctattctccagctcgataatggcgccgcggtccgcagagctgacgtgggcggcgtatttggccagagccgggccgcgtggcttgaccagaggcttccagacggcccggcggcgctcaagctcctccggggagaccttcagctcaaggcggcgggccgcgatgtcaatgaaaatttcatcgccgtcctccactagggcgatggggccgccagcggccgcctccggggagatatgcccgatgcaggggccatgggtggcgccggagaagcgcccgtcggtgaccagggcgcagtcctcgtccataccccggcccatgatgagggcggtggtggagagcatctcccgcatgccgggcccccccttggggccctcataccggatgaccaggacggtgcccttctcaatggtcccggcgctcaccgccgcgtccacctcctccatggaattgaacacccgcgcccggccggagaaccggtacatggagggcttgacacccgactgctttaccacagccccgtcgggggccaggcttccgcagagcacggcaatgccgccctccggcttctgggggtgctccatggtgcggatcacgtcgttctccacaggctccacggcgtccagcatctgacccagggtctttcctgcgacggtcatcacgtcccggtggagcttgggctccacgtttttcagcaccgctggaatgccgccgcaggcgtccatggagacgatggggtatttgccggagggctggaggttacatacgaagggcacctcccggctgatgcggtcgaagtcgtccagtgtcagctccacgccggcctcgtgagcgatggccagcaggtggagcaccagattggtggaggagccggtggccatggcccccgccacgccgttgagcaaagcctcccgcgtgaggatttgccggggggtgatgccccggcgcagcagctccatgacctgccggccggactgcttggcgatgcgcttgcggcggttggacaccgccggagcggtgccgcagccgggcagagacatgcccagtacctctgtgagcatacacatggagttggcggtacccaggtgggcgcagcttcccacggtgggcagggcggcctcctcggccttcttcatctcttccacggtacagctcccctgctccacccggccggggaattcccgcagctcactggagcaaaacagagggttgccgcccacgttgccgggcagcatggggccgccggtgaccacgatggcagggatgtccagccgggcggcggccatgagcatgccgggtatgatcttgtcgcagccggggatgagcaccatggcgtcaaagtggtgggcctgcaccaccatttcgatggagtcggcgatgagatcccggctgggcagagggtagcgcataccgcagtggccctggcacaggccgtcgcagatggcgatggtgccggtttcgcgggggatgccgcccccctccaggatgccgtatttcacctgctcggccagttcccgcatgtgcatgtggccgggaaccatctcgctgaaggagttgatcaccgccacaaagggctttttcatgtcctcctcgtccatgccggtggcgtagagtagggcccgttggccggtgcgggccacgccgttggtcagctcactgctggccaggccggggttcttgagctgaaagtcccagtcacaatccatatccgcctcccattaagccagcacgccgatgggccagggcacaaactcgttttcacccacgcccagcagttcgctcttgctcctatcgccggaggccacttggaggatacgctcaaagatgagctgccccatctcgtccaaatccttttcaccgtcgatgatgaccccgcagttgatatccatgtccccctccatccgctggtacatgggggtgttgctggccagcttgagcacgggggagggcacaccgccgaagcaggagccgcggccggtggtgaaggccaccatggtggcgccgccagccacctggccggtggtggccacagggtcgtagccgggggtattcataaagaccaggccgtgctcggtgaccttttcggcgtagtcgtacacctcgttcagggcggtctcgccccccttcttggcgccgcccagggatttctccagcacattggccaggccgcccttgttgttgcccgggctgacacggccgttgatctggcagtccttgccctcgttgtacttcagccaccagttgatgtgatccaccagcttctgccccacctccggcgtacgggcccggcgggtgagggtgtgctccacgccgaagatctcagtggtctcggagaggatggcggtgccgccgtttttcaccagcaggtccaccgcccggcccagggcggggttggcggacaggccggagaagccatcgctgccgccgcactccagggccagcaccaggtgctcggcggagacggtctgccgccggcaggcgttgaccacgggcagcagctgctccaccctgcggatgccctcctccacggccttggcggtgccgcccacgtcctggatcaccagcttctggagggtctcactctcctgaagaccggcgtgctcaaacatgccgtcgatgttgttgcgctcacagcccagggccgtcacgatggccgcgcccagattggggttggtggcatagcccatgatggtgcggcggagcagatccatgaagggaccggtcatctccatgccgcagcccaggccggtgacgaagggcaccactccgctgacgttggggtaggcggccagacgctccggggtgaagtggttggcgatcttccgggccacggtggcggcgcagttgctggccaccagaatgccgatgtagttgcgggtggccacccggccgtcggggcggacgaagccctggaaggtggcccgctgctccggaggcaggagctcggtggggtgatagtcccggctgaaggcgtaatccagatccacgtgctcaaagacgatgttgtggctgtgcatcatggtgccggtgggggtgtcctccgctgcaaagccgatgcaggtgttgtacttgagaatcggctcccccttccggatgtccctggccgcagccttgtagcccgcgggcacctcggtacgggtggtaaagccctcgctctccacctccatgccggcgggcacgtcccggcgggccaccaccacattgtccttctggttcaggcgaataaaaggagaaatctcccgtttcataccgcatacctcttttacaatcggatgggactgccccgcccacgggcgaggcagtccatgtgttcttgtgggggaggagctcaggctgccgcgttggccgcggcccacagctcctcgtactcggcctggatatccgccagctggctctcgtagtcggccggggacaggtaggtaggctcgttgcccagatccaggatggcctgctgcacctcttcgtcctccatcagctctgccactgcggtatcaaaggtgtcctgaatgtccttgggggtgtccttgggcaggaagaagccgaattcatatccattgtagagccaatccacgccctgttccttggctgtgggcacgtcgggatagactgcgctgcgctcctcggccgggaagcccagggccacaaaatcaccggactcgatatagcccttggccgtagagtactggttgggcatgatatcgatatggccgcccagcagcgcggtacatttgtcggagttggagcccacatctaccaggttaaactgcacgccggtggccgcctcaaaggacttgaccatcatgtaggtaaagccgcccacctcgacgcccatggtgacctctccggggtgctccttgcagtaatcgatcagctccggataggtgctgtagggggcgtcggcgctgacatagaatccagtggcattgtcggtgaccacatggggccccacagcgaagccctcgtaggagtagtcggacacgccggtgacattgttgatcagcagggcattgtggaagaagaggatggtgttgccgtctggggcggcctcatgaacctggttgatgccgctggagccgccggcgccggtgacattgaccaccacaaaggactgtcccaacttggccgtcagtttctcggccagaacacgggccagcagatcggtaccgcccccggcgctggcagggacaacaatggataccgggccggagggccaccctccgcctgaggcggagcctgtattaccggcggcatcaggggattcggtgttctcgctggtgctgccgcagccggccagcagggttccaaccagagcggctccagtgataagggcaagcagtctctttttcatgggaaaatcctccttagtgaatattgatttcgatctcaatgggctcaagccgcacccgcagtctcctttttgcggttgcgcacctgcttgattaccgtccacaccacgaacagcaccgcggccaccataaacacagcggcgatggggtgggtgaagaaagccaaaaagtcgttctgggtcagcatcaggccccggcgcaggttggtctccagcaggtcgcacagaatgaagctgaggatgaaaggagccacggggagcttaaacttgctcatcaggtagcccagcacgccgaagatcacgatggactgggcatcaaagatacggttgttggtggcgaaggcgcccacggtacacagcaccagcaccacagggagcaggatgtactttgggatactcagcagacggacaaaaatccgcatgccgcccagctcaagcaccagcatgaccacgttggccagaatgcaggcaatgaagatggtgtagatgaggtctgcggactccacaaagagcaggggtccgggggtgaggccgtggatcataaaggcccccagcagcatggccgtcacaccgtcgccggggatgcccagggtcagcagggggatgagggcgccgccgatgactgcgttgttggaggtttcggaggccaccacgccgtccatgatcccagtgccgtacttctccgggtgcttggaggtctttttggcggtcatccaggagagaataccggcggtggagcccccgatgccgggcaggataccgatgccggtaccgatgagggcggagcgcagtgcgttccacttctgccccacgaactccttccaggtgaatccgaagcccttgattttaaagctctgcttgacctgagtggcctttcccatctttttgacctcttcagcgtaggccagcacctccgcaatggcaaagatgccgatcagggtaggcaggatgtcaaagccggaggacagttcgttgataccgaaggtgaatcgcttggttccatcaatgggcgccatacccaccaaggcaatgatcaggcccaggcagccggagagcagtcccttgatcatgctggtgcccgccagggcggcgatcatagagagggcaaagaggcacacgccgaagtactcgatggcggaaaacttcagggtaatctgcgccacggaaggggccacaaacataagcaccagaaaggagaacaggccgcccaggaaggagaataccactccggtacccagagccttgcccgcctcaccctttttggccatgggggagccatcgaagcaggtggcgatggaggaggaggtgccggggatgttgatgaggatggcagagatcaggccgccggagatcccgccgatgtagagcgccacgagtagggtgaacgcctcatgggcctgcatggcgaaggtgaccggcaggaagagggccaccgccatggcggcggacaggccggggatggagccgaacacaatgcccaccgcgacaccgacgatcagcagcagaatggacatggggttcatcatcccggcaaatgcgtttccaatcagggataaggtttccatcagttgcgcctccttttaacccagtatgccggcgggcagcatgacattcagaccgaaccggaagataaagtaaaccgcgacgcacaccacgacggcgatcaccgcgaacaggatgatccctttgatgccccgcttctctttgggcgccaggatagtgatctgtgcaaacaggtacacgatggagctgaggaggaagcccgccggctcaatgacaaacacatatacggtgaatgccgcgatggtggccagcacccgcaggtactccggcttctcctcctccgctccttcattcggctggaagcttcgcatggtgcggaatccggcacggatttgaaagaaggagaggatgcaggtaatgatggccagaaccttcggcatgaagccggagccaagtccccccatcaggctgggcggcagtgcgctggccgccaggaagagggcgatggaaagaatcaggaagaatacgcccgcagccagatccccgaactttttcaagaacattgctttgatccctcatttctctgtttgtcgttccacagttgctgtctcatccggataactttattatacacgggcacaccgtatgtgcactgtgacggcaacacaagaatcaggcgctatcttatgtctttaatacatttccacaaatacagcacctaagggcgcgcacctctttgggcactattgcgctagtcccccggattcagaaccggctgcaatccaccttttcccgggcagccatagagcatgcctcgccctccaccaccacctcgcccctctgattgacggcggtggccttcataacgatgcggccggggctgaactttaccgtgccgtcgggtttggtgacctcctcgccctttttgaccacctcaaaggtggcggtgatggtgtcccccgcgtagaccggcctgagaaagttcaggctctggcgcacatagaggctgcctgcgcctggcaggtaattgcccgccagggtgctgaacagggcgccggacaggaagccgtgggcgatgcaccggccgaaggggctctgctcgccgaacgccttgtcgatgtggacggggctgtagtcgtccaccaggccggcaaaggcgtagatgtcgcccctggtgatggtcttggtgaccgacgccttctgccccacatagatttcatccagagtaaagctgttcatcgtgttttccctctcaatcctggagcacaagccccattttttccgggcgaaaaattcgcggatccatctctttcagatcggcagccacagcaggccggaagcccatcagtggatagatgtcccgctccagctccgcgccgggggccacctccacgagggtcaggccttggtcggtcaggcggaataccgcccgcgccgtaatgtagagcacctcctggccggtctcccgcgcgtaatcgccggagaaggtgatctgctctacctccgggacaaacttgaccacattggagtccttgacgatgttcagccgtccgttttccaggcggatatcggtgtccttcaccgaggagaaggtgcccataaagcagattttcttggcgttctgcgtgatgttgatgaagccgccggggccggtcatccgcccggcgaacttggacacgtttacattgccgtggcggtcgatctgggccgcgcccagataggcgatgtcgatgctgccaccgtcatagccgtcgaaaatctcggtgtgcttgacaatggcctccacgtcggcggaggcgccgcagccgttgccgggggctggcacgccgcccagtgtgcccgactcgatggacagggtcatctcgccggccaccccctcctcgccggccacggaggccacaccgtcgggcatgccgaagcccaggtttaccaggcactccctccgcagctccatggcgccccgtcgggcgataatcttgcggatgcccagctccattggctccagggcacccatgggcaccctgacctcgccggtccactccggatggtaggggacggcgtcgaagtagtgctggcggctgtactccggccgccccaccaccacatagtccacgaagcagccgtggaccttcacgctgcgggggtccagggtgttgtcctccaccagggtatccacctgggcgatgacggtgccgccgttgttcttggtagcaagggccatctctaactgctccagaaacagcccctccttctccatggacagattgccccggctgtcgccgtaggtggccttgatgaagcacacgtcggggggcgtcagcttgtagtggagcagccggcggccgtcgatctcaatgctctggacgatgccccggccctcagtgtgggctttcctggccgcgtcgttgaagcagcatgcctccacctccgggtcgcagaaggtcttgaggcccacgtgggtaatgacgccgcacttgtgccccgccatggcccggcacatatgaaccagcaccccctgaggggcgcaaaaggtctcgatctggttgccggtgatcagagggttgagcttgggagccagacctacgtgggcgcccaccatacgccgcaccagccccgcgtgggccaggtggttggcgccatgttccccgccgtcgccgatggcggaggtgtagaacacgttcagatcccttgggtggccctcggccagaaagcgctcctccagggagaccagcagctcctccggaaccgacagtgtcacgaagcccagcatgcccagcgtcattccgtcctgcaccagggctgcggcctcctgccgggaaatcactttacgcaatgtactcactcctttgtcaattgggcggcccgctccctgcggatgccctcatagagcccctgggcgtaggccgcccccagggcccggtcaaacagaccgtagcccgcggcgggccgggcgccgtcccatccgtccggccggtgctctctccgccggacgccgtcggagccggtcacctcccgaacactccacgcctcgtcccagatgcggcggccgtgatcagggcggagacagaaggggcgccccatatcacacagggcccgcatgatctcccccatgtcgttgctgccgcagccggtctggtggccggactcgtagaaatcgcccccaggctcccgctggacgttgcggaagtggacaaaggggagcttccccctgggaccgaattcccggatcatggcgggcagatcattgtccgcgtcggagcccagggagccgcagcagaaggtgatggtgttgctggggctgtccaggtcgggggtgaagaggatacgccggtagtctgcggcgttcttggcgatgcgcggcaggccgaagatgggccgcggcgggtcgtcggggtgaagggccagcttgacgccgcactcctccgccaccgggagcaccgcccggagaaaatagcggcaattgtcccacagctcctcctccccgatgccccggtagctgtgcagcagggcctggagctccgccggagtgtggttggtcccccagccgggcagctcaatgcccctctccgggtccacggcccgcaccttttcctcctcaaagctcaggcagtccgagccgtcggggaggacatgggccagatcggtacgggtccagtcaaagaccggcatgaagttgtagcagatgatccggatgccgcactccgccagcatgcggatgtttttccggtagttttcgatgagggcgtccctggaggcatagccccgcttgatgtcctcgtgaatgcggaagctgtccacaagctcaaacttcaggccgtgggcctcgatctgctccttcaggcgcagcacctccccccggtcccacacctgccccaggggcagatgatagagggaggtgacaatgccgtacaggttgggaatctgcgcgtactggcgcagggagatggggtccttctccccgtgccagcggagaatcaggtgcatgtcctccatgggggcctcctcagtacgcggaggaggcggccaccgccccgcccccgcgtacctggctcaggaagctcctgccgccggacaccatgtactggttgaccgcggtgaccagatagcgggccccccactcctcggcctgtctggccgcctcaggcgtgcccacgtagtagccggcggtctttcccgcggccacgatacggcggatcatccgctcggtcagctccagcattttggggctgccggcgggctccccgtaggaggcggccaggtcgccggggccgatgaagtagacgtccaccccgtccacctccagaatcccatccaggttctccactgcctggcgggtctccacctggcagcacaccagcttggtgtcgttggcctgcctcaggtaggcccgcttgtcctccaccatgccgtaccgggcggcgcgggggaggtaggcggtgccccggcgcccctggggggcgtagttggccagctccaccacccgccgggcgtcctcggcggtgttcaccagggggagctgcacgccgttggcgccgaagtccagggccttctggatgtggtcgtactccttcatggtgcaccgcaccaccgcgggcaccccccgcagctgggaggcccgcaccatgtccgccagggtgctctgctcgatcaccccgtgctcgttgtccagcagcaggaaatcaaagcccatcagggccgtgacctccgcgatgtccggcaggccgtaggtcacaaagcagccgtacagcgtccgttccttcaacgcctctttccacggcgtcaggttgtccatatccgttcctccttttctcagcgcagggacgcaaagagggacgcgatgtcctcccttgtggccttgcagatgtcgtttgccatgttgcccgacgcggcggcgttggccgccagctcgtcgagggcctcctgcgtatcgggcacgcccatggcggtcagggtggtgcgcatgccggtgagctccttcagctcggccaaccggtcggcggccgcgttggcgtcggcgaagcccatcatgcggctgagggtgtggagcagcgggcgcaccgctgcgtccttccggaaccaggcatccagggtgagggcgcaggcctcgccgtgggggatatggtacttggcggtcagcaggtaggagcaggcgtggctgccggtggtgcccgtattgctgaaggcataaccggcgatggtgctggccatggccatccgctcccgcgccacggcgtcggagccgtcccggaaggcggcctccaggttctcaaaggccagcttggcggcccggacggccaggccgtcggacaccgggttggcccggaccgagcacatggcgtccaggctgtgggcgatcacgtccaggccggtggaggcggtgacggcggggggcacggtgtaggtcagcaccgggtccaccagggccagccgggggaacatggggctgccgaagatggcgattttggcgttggcggcgtggtcggagagcaccgcgccccagcccacctcgctgccggttccggcggtggttggcacggcaatgaggggcagcgcatcggtgacgggcctcccccgcagtagctccaggccggtgcagtccatggcggccgcagccgccgcggccttggcgcagtccatggcggagccgccgcccaggccgatgatggcccgggcccccagctccctggcccgccgggcacaggcgtccacgttgtcacaggtgggattgggctccacctcagagatgatgtccagcacgcggccgcccgcgcactcattcagccgcgcggccacgccgctgcggtgggtgaagggatcggagacgatcagcgcccggtccagcccccgctcggccataagctgtcccagctcatccagcttcccggtgccgaagaccacttccaccgggttgtaatacttccacatggcagcaattcctccttgcttgtcggtacggcctgacggccgttatctcgcctctgcatacctcaagtatagcacggccccccaccctgcctaatgtgtcgcggtcacaaagttttgtgccaaaagaatgactgcggcactgatttataccagtccgccgcagcggctgcctccctccttgttccagctccatagaaaagctttgtaaagctgtgtcagcggcacattccgcccagcagtcagatctgtcatactggatatacaacatagagcgccccgaccggcgcagaacatgaggtgaagcaattgaaagaatttcgccataccgttatctaccacaccgactgtgcgctcccgctgtatgacgaggtggatgtcctggtctgcggcggtgggccggccggcattgcggcggcctccatggccgcccggcaggggcgctccgtccttctggtggagcggctgggttttctggggggcgcggcagtggccggtggttccggcacggtctgcggtacatttctgtgcagtgacacgccggaagccgacggcccccgccagaccgtcttcggctttacagaggagtttctccaggccatgcgcgcccggggcggcgtgacgcccccgcagctctacggcaagacctatctcatcacccacgatccccaggtctataaagaagtggccgaggagctggtgctgggcgcaggggcgggcatcctctatcataccaatattttcggcgtcatcaaggagggggattttttttatggggtggtaattgataccaagagcggcctggcccagatccgcgccaaggtgctcatcgacgccaccggcgacgcagatctgatctaccgggcggggggcggctacaccatgggggacaacggcaccatccagaatcccaccgccatgttccgcttgggcggggtggacacggcgcgcttctccgactactgggggccggacactatcagtcccgactgtgtgacggagctgctccacgaggccaaccgccagggctggcatctgccccgggtcaaggtctgggtctttcctactccccggcccggtgaactgctgatgaacactaccctactgaccggccgggacggccgggcgctgaacgtatgcaacccggaggaccacactgaggcggagatcgtcggccgccgccaggtacaggaatacgcccgcttcttccgggagcatattcccggctgtgagcacagctttatcaacgactgctctcccgaagtgggcgtccgccaaacccgcagcatccgcggcattgcgcggctcaccaatgacgacgtggcccatgcccgcaagcgctccgacggcatctgtcgctgcccctggcccattgaactccacgccggtaaaacgccctacctgttctggctcatcaacgattactacgaggttccctacggctccctggttccggaaaccggcgagcatctgcttgtggccgggcgcaacctgtgcgccgagcaccaggccctggcaagctgccgggtcaccgcccagtgctttgaatatggacacgctgccgcgctggcggccgacctgtccatccggcgggatctgcccctgcgtgagctgtccggcgctgaaatccgcgcccgtatgaacgaaaacggcgcccgcctagactaaacctctatgtgaaaaggcgccctttcaggcgccttttcacatgcccggatacccaatcagttgtgctttctgcccagctatggtacaataaagggcaaaaagggaggtgccgcccatgatcaaccaggcctttgctgagcagtttatccgacgcatccgctcccagaccgactacaacatcaacatcatgaatgagcacggtatcatcattgcgtcgtgcagtgaagagcgtgtgggcaccttccacgctaccgccttccgcatgatcaccaacaacatcagcatcaacgtcaccgaggatctgaccgaggatctccccggcgtgacttcgcctggggtgaacctgctgctgcgggagaacctgatcccggtgggcgtcatcggcgtctccggcgatccatccaccgtaatgtccctggccaagctcatcaagctgtcgtttgaatcgctgtacgactacgaactccagcgtgaattcctccccactgcctccaccggcgccatgagccatctggcccgccttctctttgtggaccgcccggtcaacatcatgcgcatccgctcccaggccgctgaactgggtatcactgagcacgtcaaccgctatccccttcttattgagtatgtggggtgcgagagctccgaactggtgctttcccgctttgccgaggactacccgaattcccccagtcattcccccaacgacctgctgttctgtatcggcggcaacctgctcctgctcttcaagcagattgacgaaactacggtggccacctaccgcaaccagatccgcctgtgtatcgaagaaatcgatgcatggtttgaatctcaggtgcccggacagaaaagccgctatatctgcggcacggttcagaaccgcttttcctattacggccgcatctatgaggatatcatgtggctgtaccgctaccgccagaagaaagagcttaaggtgtactttctagccgactacctgaccgaatacatgatgagccagatctccaccgagaccatggcccctctgttggacatctatgtacgcctgatccgggggcatatggatgagtccatctttcgtgagaccatcggcgcgctgatcgaaaccagtatgaacctgagcgaggcggcggagctgctctatctccacaagaacactgtggcagcccgggtcaagaaaatcaaagagctgctgggcatcagccccctgaccagcattcgggacgcaattttcatgactgccatctacaattacctcaatatggtttagcacattgtttccagtcgatgcccggcagggatatcctctccaggcactctggcagcgggcggcataaaacccgtcggaatccaaggattccgacgggttttatgccgcagagaggagatttaaaccttgggtcttcgaaccatgcggggccgccggcggatgcagccgatcctatcagagccttttttacaatgtagacttgccctgccgtatatatcaagtaacataaatcacagctcctctggcttgaggtgcacgtcaatctggattctgcggttcagcatacggattatcccctcctcacatgacttattgagcggtttggagacggtgatgcgcgaacttatgatgatgatactcacgtcgttttgagtgtactgtatctgctggttgtaccaccggccgtccaccagttgggagcggtcggcagccatccggaacagctttagcagccgctccttatatgcgctaaaggtaatgcttttaaacccgtggcgcatgatgagcatcttttttgcgttatccataataccgcatctcgaaacagcgcagactcatccatagccgccgaaatgtgttgtgctccagtttatagagtgtcctctgtatgtccgcctttgatatgacagtacttggttcgtgcaataaattgaccgcttccccagctgggggtattccctttttgtcacgggatagaaaggggccgccggttctttgaaacaccggcggccctgttgaagggttgctttcaatccggggactacattccagcttatgtcttcagagcacagatgacagaggctcagctcccagtcagcgcgcagccgatgggatatcctacgaatccaatgatcagagatgtaattacaatcatgataatgccgaacagatatatctggttgcggctgctgtactcgtgtccgtggagcatggcaatggtggcgaaggaggagggcagcaaataggcgcatgagccgcacattgttgtcaccagggcaatgcccaccgcgctgatggctccgccgctgctggctgccagagccacacccaccgctgtcattaccgtgatagtggacacgttggaagcaaagttggtcatcaggacggagacagtggcgatgacaaacaccaccaccacaggcgccacgctttgggtgaggggggtaatattctgctgaatggcggccacgattccggtggaatcggcgctcatggcgctgcccaggtagacaccgatgctgatgaaaatcaggatgccccagttgatgctctggttgaccacagtcctgacgtccagcaggggcctgccgtcaatgtggatcaccgccattaccaccacggataggatcgcccagaaggtaatgccgaaactgttgaaagcattgacccaagcggtatcgctgaacatcttaagcactccgggcagaatccacatgataacggtcacaaagaataccactgcagtggtaccctcccgcagcgtcatggggccctgctttttgacgacgttctcaatcttgaagtccttgaatttggacatatccggacgggtcagcaggcgcaccgcgacgcacagcagaacgaacaggatcaggcccgtgggcacgccgaaggccagatagctgaacagactcaggctctcccctgtggccccctcataaatgccgatgcccagaatggccaaggagtgggagatgggggtcatggctccgccgatgttgacgccgaacactgtgaggatgttggccacatggggataggcatcccgactggtgtagcccagctctttgtagatgcgggagacaaacgccagcataaaggcggtggcgggcacctgatccataaagcaccccaggagcatgccgagcacacccagggaaatggtaaaaatccaggggcttttgctgaccagcttgatgctcataaatttggctaccagccggtcggtaaaaccggactcgttgagggcatgggtcatgataaagctcatcagcacaaaatagatgatccagttgccgatggagcccgcgatggcttcattgacggtgcatacgccgctctctcccagcagcacgatggccagcatagccggccacaccgtatccacaatggacagcatcaggataacgccgatgaagataccgatgacccgcataccgacggcggtcaggggcgccaccggcggagccacccagaaggcggcgatgaccgccaggcagaccagaattttgatcaacagggaggccggcatatagaatttctgcttttccattcgtctcttcctctccgtcagattgggcttaccggccgagcttcagaatttcgcgggcctcgtcgggggtggcgacctccatgcccagctcgcggatgatgcgcacggcccgctccaccatttgggcgttgctcttgagcagctctccgggggcgtagtagatgttgtcttccatacccacccgggccccgccgcccttgaggacggtcatcgccatgccgggaacgtgatgtttggcaccgatggagatggtggaaaagttcacaaagcggtccttaggcagcttcttgatcatgaagtccaggttctcctcggagaaggagatggagccctggctgatgcggtccatacccatgacaaaggagagtgagacgggctcctccagcacgccggctggtaccagtacattgaacacgtcctccacgctctcggggttgaagcactccagctccggcttgatgcccatgtcccgcattttccgggcgtacttgagcaggaaggggcggtaccactcgtagacaaaggtacggtccccccagctcgtgccgatcagggagcagtccagggagcacatctcaggcttgaccaggtcggggtcgtacagcagcctcatgccgtcctcagcgcaggttccctcccggtttgcgggggcggtagagtactgaagaatggcattacacctggcccggatgcccgagccgatggcgctgtataccttgggatcattggtggacaagccctcttgatcccgggcgtgaatgtggataatggccgcacctgcattgtagcagtcgtacgcggaggccgcaatctcctccggggtcagggggatattgggatttgcctccttgccgtggaacgcgcccgtctgggccaccgtgataatcacttttctcctcgccataatatcgctcctctacacgttctcgtcataggatgacgttcgtttgccccggcgtgaagggtaaaaccgccggagacattctgttcttaaagcaaacgcagggccaactcctccattcagcatttttcgccccattttgcctgttttttgagaaaaatgcgtatttagccggggcatcctccatcaaaaacatgcacttatgcgcatttttaggtttcatattgcgcaaaagcgcctattcgttgcgctgcaacgaataggcgcttttgtgacgggcaccgggcgcaaaaaacaggcatttatgcgcaatgagcgcctctgtatgcggcagcggccggaggggccgccccctgtctcccgcaccgcttataatggattcttccatattggcatgcctcttgctgattccatgggcgaaggccccgctcggtaagcggggcgcggaacacagaaaggatgatgtgatgtggcgcagcggatcacagccgaggaagcggctgctctgattcaagataacatgacccttggggtgggcggcttcggcgcctatgcggctccggacgagcttctatccgccctagcggaacggtatgagcgcctgggaagccccagagccctgacggcggtatgcggcatcagtcccggcagcaaccggcccgacggccgcggcctggcccggctccgggctcctggcctgctggataccgtgatggccgggcactttgccaacccgcccgagatcgccgagctcatcggcaccaaccaggtggcggcctatgccctgccccttggcgtgatgctccacctgtggcgggcgatcgccggccacaagcccgcggtgctcacccatgtggggctgggcacctttgccgatccccgggtggagggctgcaaggcgaatcaaaaaacccgggctcagggccgggacatcgtggagttagtttcgctggacgggcgggattatctggcctacaagaccttccccatcgacgcctgcttcatccgggccacctgggccgacgaggacggcagcctgtccatggaggatgaaggcgtgggcgactatgccgccgaactggccgccgccacccacaacagcggcggcattgttattgcccaggtgcgggggatcgtcagccgtggctctctgccgcccaagagcgtacgggttcaccacccgatggtggactatgtggtggtcaataccgacccggccctgcatatgcagagctacgcggcccagctccgtccggagctcagcgggcagctccgccgccccaccgactccatcccgcccatgcccctggacaaccgtaaactcatcgcccgccggggagccctggagctgcggcccgactgtctcatcaatctgggcatcggcattccctccggggttggagtggtggccaacgaggagggcatcgcccagcgcatcaccctctccctggagtccggtccccagggcggcgtgccggtggagggggctggattcggttcagcggtcaacgccgaggccatctataccgtggccgatactcttgagctttatgacggcggcatgctggatctgtccttcctgggcgcggcggaggttgactgccgcggcaacgtaaatgtctccaagttcggctcccgctgcaccggccccggaggctttgtcaacatctcccaaaataccaaacgcgtgttttttaccggaacctttaccgcaggcggcctaaaggaggaggtgcgggacggcaggttggttatactgcaagagggcaggagcaaaaaattccgccgtcaagtggagcagatcaccttttccggcgattacgcagtcaaaagcggccaggatgtgaccttccttacggagcgggcggtgctcaagctgacgccggatgggctgatgctcaccgaaatcgcccccggcgtggagctggagcaggatattctggcccagatggagttcaggcccctgatttccccggagctgcgtgagatggaccaccgcatctttcaggcgggccccatggggctgacactgtgagggggacgtttatggaaacccgggtcaaggcgccgctggccgcaaaccgtcggcgcgcccttctttttgtgctcacactggtgctccccgccctgattcttctgctgcgccccctcggctttaccctacagcagtccgtcatcctcgccgccctggtgctcaccatcctgtggtgggtgaccggggtggtggagcggacagcggcctctctctttttgctggcggcctttttgctgtgcagcggcgcgccgatccagacagtcttttccttccccctgtcagaaaattttgtcctcatcaccgtctcttttctgttttcccaaggaatttccaacagcggcctgccgggcaagctgctccagcctcttctggcgcactttgcccgctcccccgggcgtatggtgctctccctcctcctctccgccgcggccatgatgtttctcattccccagcccttttcccgcatcattatcctttcgttgatctaccgggagtactttgctagaataaacctgtccgagcctttgcgcaccgccctcctgttcggcctttattatttctctattttgataaatatgtccatgattcggggcgatattattctcaatggcgccctctcctccatggccggcctgaccgtagatgagggcgtctgggcggcctatatgctggctcccaccctggcctacctgctggcggcggtccttctctaccggttcctgttccgcagggtgctgcgcaccttcccctccagcccggcacagacggcggagcgggttcagctcactgggtcggaacggcgcaacctggtctttctgctggccgtggtggtgctttgggccaccgaggattttcacccccttaccggcactctggttgtggcagccgccacggcgctcatgttccccctggggctgctgcgcctgccggacgtaaaggccatcaacgtcaagctgctgattttcctcacagcggcctttgctatcggtggaaccttaaagtcctgcggtgtggccgaccggctgttttccctttttgttcctgtttttccacagacattctcgccggcttacgcagcggtggttctgctgaccgtggtactgctccacaccgtgctgggcagcaacatcaccaccatgtcggtggtagtacccgggctgatgttcatcggtgccggggtggcccctcctcttccgctgatgtttctcatctgcattgcggtgtgcagccaatttcttctgcccttccaccatgtaattctgctgctgggtgaaggcgaccgctgctattccacccatgagctgctccgggttggcatcccccataccgctcttatgcttttcgccgtatttctgctctatctcccctggtggcggctgctgggggcgctgtagggccaagagaggaggcttccgccccatgtccggcgctaatatcaaacgcctaatggatccggagatcctggcggctatcatggactcggccaccgacggcttcacctatacggacgaaaccggatatattgtctacaacaaccgggcttacagtgaaatgaccgggcttccggatgaaaagatccaggggcacaacatccaccagcttgtcaaggaggggtttcccatctcgcggatgatgctggaggtgttccagagccgggaaacccgctccgaactcatcaagtaccaggccgactccgagcggcttctcctcgtcaccctctcccctgtctacagcccggacggacgattccgcggcgcggtgggcaacgtgcgggacatgaccgagctgatgcagctccgccagcagatggacatcacctatttggactacgaccgggagatgcaggtcaaagagaaggccaaccgggagctggttcagcgcatcaatgagatgctccacctgatggaggactacgacatcgtaggcaggagtaaggccatgcacaacctggcggagctggccctgcgggtcagccacgtccgctccaccgtcctgattaccggcgaatccggcgttggtaaggatgtcttttgccgcatgatctgccgctttgcgggcagcccggactatatcaagatctcctgtgggaaccttccggagaacctgctggaatcagagctgttcggctatgaggccggcgcctttaccggggccaaccggacgggaaagcggggaatctttgagctggcgggagacggcgtgatctttttggacgaaatcggcgaactgccgccccagctccaggtgaagctgctgaccgtgctccaggaccgccggttctaccgcatcggcggcaccgctcccctgcctatgaacgcccgcgtcgtggccgccaccaaccgggatctgaaaaaagaggtggcccagggctccttccgccgggatctctattaccgactcaacgtcattcccgtgcacattccgcccctgcgggagcggacggaggatatcctgcccctggccgagcacatcctgctgcgcctgaaccgccagcagggaaccgcgaagctgtttggccaggccttcaagaaggcccttctggcctaccgctggccaggcaatatccgggagctgaacaacatcatcgagcgggcctttgtactggcaaggagcgacaccctcgagctggaggatctgcccgacgagatgaccgcccagtggctacagcgtacgccccaggggccggtaccggcgggctccagcctgcactgcattttggaggaagttgaggccgcagtattggcccagcgtcttcaggaggaccgtaccctcagcgagattgccgccactctcggcattgatctgtcgactctggttcgcaagatcaaaaagtacaacctgccaaagcgccacaaccgtggaaaataaaactgtgagagaatcatgtcataaaaatgcagggatgtaccccaggagggatgggcttgcggcaggggcagcccaaaccattccctgcttagaggggggaggctgatgcctcccccctgtcaccctcatttggattcggctgaacggttctcctccgtactctaccaccactttcacccgctttaagacagcctgtccgcccgcacacggtctttgaattgtgtgcatgcctccctgcaattctccagaaggcattggatctcactgccatccgcgtggtcaatgtggatgccgaccgctacactgacattgcatttcagctcggtagccagatactttgccgcccaccgtgccgcctcgtcgtctctgtgtccgaacacacacagcacactgacggtagcgccgcgcattttgtgtcccactgttccggattcgtcgcaccccagcgccgcagctcccacatgatgacggcccccaccgcagattgtgacactataatccctgccacactggacggcacagagttcaatttcatatttgctttgccctgcaattgtaatatgatactcctccatagcgccccatccttatccctgaatttttatttatatgataacaatactataaggaaatccatcattagattgtgcatcttagaggcagctccacgctctgtcgtccaaagcgtggtataaattgttgccgataggacaccgcaatattatgcttctcatttcaaaaatgaggcttggctgtgctttctcacggtatttgcagcaacatttctgcctctcaatgcatctgcccgagactttaaggcacaaaacaaatggtcgggaacgcagagaaaaggcactgtatttctacgaaatacagtgccttttcaaacgctgcgccggtctgaatcgttccgccgtacggtgttgagcatcgacccagcggtatttctccgctattttgtgagcagtcccattccgtctgcgctccccatgaccggtatcagcgctgtacccggccggagccgtctccaccggccagcttttcgacctccgccacggtaatgcggttaaaatctccctcaattgagtgcttgagggcggaggccgctacggcaaattcaatggccgcctggctgtcctttccagccagcagggcgtaaatcaatccgccgccaaagctgtctccgccgcccacccggtccacgatgcgcaggtgatactccttggagaagcagtagtgttccccatcgtacagcatgccggcccagtcgttgtcgctggcggaaatggagctgcgcagggtgatggccacccgctcaaagccgaactggtcagccaactgcctggccacactcttgtagccttccttatttaacttgccgccagtgatgtcggtctccgcagcctcaataccgaacacgtccttggcgtcttcctcattggagatgcacacgtccacataccggcacagctcactcatggccgcccgggcctgctcccgggtccacagcttgccccggtagttcagatcgcaggagatcttgactcccctggccttggccgcccggcaggcgtccttgcagatctccaccacattggggcccagagcgggcgtgatgccggtaaagtggaaccagtccgccccggcaaaaattgcgtcccagtcaaagtcggcaggctgggcctcctggatggcggagtgggcccggtcgtagatgcacacgctcccccgctgggaggcccccttctccaggaaatagatgcccacccggtctccgccccggacgatatgggaggtatcaacgccaaagctgcgcagggcgttgaccgccgcctggccgatggcgtggccgggcagcttggtaacatagacggaatccagcccgtagttggccagagagacggctacattggcctccccgccgccgaaggtggcctgcaactggtcgttctggaagaacctataatagccgttgggggccaaacgaagcatgatctcgccaaaagttacaacgcgcttgttcatggtacgtccctccttatttctgcaccaggtggatggcaaagcccccaaagtctccctccaggtagaccgcccttgcccgccccttggcatcggtcttacaggtggcgtggtcaatcgccaccccgcggcgctccagatgatagatggcccgctccacactgttggtaccgatggcgatgtgtccgtggacgccggggccgggggccttggtgcactccaccgccgtccccgcgtggttggagctgttccccgcccggaagggcaggccgaacaggccgcagatggtcctggccgtgcgctcggacgcctgggcgtccaggcagttgatgcccacatgggccaggctgaagcccagcatggtatccaccgcctcccgggtcaagcgggtgatttcggcccagttctccgcctcaatgaggtcttttttcaccatccaggtgccgccgcaggccacaacttggtcaaaggacagataatccatcagatttttggcgctgacaccgccggtcggcatccatttcagagccttataggggccggcgatggctttgagcttggccacaccgccgttttgctcggcggggaaaaacttgaccgcctccagcccaaaagccatggcctgttccatctcgcctggggtagcggtaccgggcaggatcagcccccccttggcctttacatagcgcacggtatcggggttgaagccgggactgacaataaatttggccccggccgccagggcccggtccacctgttcatggtttaaaacggtacccgcacccagaagcatctcgggcacctcagccgcaatcgcccgcatggcctcctcggcggcacaggtgcggaaggtcacctctgccgcaggcagccctccctccaccagggagcgggctagggggacggccttcttcgcatcgtcaatggcgataaccgggatgatgccaatgcggcaaatctgttccaaaatgggattcatactccatatcctttcccgtccggctacacagccgcggcgccgttttctccattacgctgaatgttattcttctgaatcgcttcccacaggccgttcagatagctggcgcccagggcccggtcatacaggccgtagcccgcccgccccttttcgtcccagatcatgcgtccgtggtcggggcgtatgtagccctcgaagcccacatcgtaataggccttcataatttcgtacagatccaggcttccgtcgccggagaggtgggccgcctcctcaaaccggccggggccggtgaacttaatgttgcgcacatgggcaaagtggatatgtccctctccgccgaactcccgtaccagggcaggaatgtcgttacaggggctggagcccagagagcctgagcacaaggtcagcccgttataggggctgtccaccagctccacgatgcggcgcatattctcccggcaggtgtaaatgcggggcaggccgaagatatcccaggggggatcgtcggggtggatggccatcttcacatcgtactgctcgcagacgggaatcactgcctccaggaaatacttcaggttgcggaacaggtcctcatgggagacattccggtattgggcaaacaggcgcttgagctccgccatgcgttccggttcccagcccgccatctcaaactcccctgccccctgttggatctgatccgcgaaggcctgtgggtcggtgatgcggtcaatgactgcctgatcataggccaggaccgtggagccgtcgggccgcggcttggccagatcagtgcgggtccagtcaaaaaccggcataaagttgtagcagatcacctttacgcccgcctggcccagccgccgcaccgtctcccggtagttgtcgatatacgcgtcccgtccgggcaggcccagcttgatgtcctcatggacattgacgctctcaatgacctccatctccaggccagcggcattgacttcctctttgagggctgagatgcgctccgtgggccagagcgcgccggcgggcagatccatcagggaggtgaccacgccgctcatgttggggatttgcttgatgtatcgcagcggtatgggatccagttggctcccataccagcgaaatgtcatcttcaaggctgtttcctccttacgcttcccgccctgctgccgtctgaagggcggaacagaatcctctgtttctgttatggctgtttacatacacaattgcggtgcagggtggcccgcactgcccccgggccggccagcatgtcccggaacatctcttctgtcctctcccccaggcctgctgcatacagatcaaccccaaagagggctgcattggacaggatggggcggagctgtcctgccagggaatcgggccggcccacttcaattcccttcaggtgggcctggagctggggcagcatggggtccgggctgacaggcatggcgtttcccctgtcatccacccccagcaggtagcggcaccagccggcgaacaccaggggggcgaactccagtccggccaatgcctgctccgactgccgtgcatagcgcctgagggtgccgccgtaacggacgggcagcttctgtgaggtgtcggctgcgatacgctgcggtgtatccgggatggcgggattggggaatcgctcatggagcacctcgtcaatgaatgccctggggctgaggataccgggatcttccaccacgggcagactctcggcggcaatatgctccaccagggccttgagatctgcatcccccatttcggcggcgatggaggtataccccagcaggcagccgtacaccgccagagcggtgtgcagggggtttaggcaagtgcccaccttcatcttttccgccttctccacggtggtccggtccgtgagatacacccccgccccttccagggcggggcgtccgttggggaaagcgtcctccagcaccaggtactccgtgatctccgcgttgacaaagggggcgataagggtgcccgtgttggtgcgggcaatggccatgtccgccacacccaggcgccccagctcctcctgcacccgctcggaggggtggggggtaattttgtcgatcatggaccaggggaagctcacccggccctcgtcctccagccagtccaggaaagcggactctaccagcccccgctccgcccagccccgggccatggacagcaccccggcgcggagcttctccccgttgcgggcacagttgtccatgctcaccatggcaatgggcgcgcctccggcctggaaacggcggtacagcagagccgccgcgatagacatggtgtgacggggcccctccggcccggcggccagatcccgctccaccaccggcaggggctttttctccagatcggttagggcgtagcccttctcggtaatggtgaagctggccatctggagagtcgggctgcaaaacacccgggtcagcctggcccagtcagggccggcgcagtcggccttgaggccgccggccacgctggcaatcacctcccgctcctcgctgccgtcggcgcgcatgcgcaccagcaggctcagggcgtcataggggctatagacctggtcaatgatctgaaagtcaaaggattcggcggccaggatgcctgtgtcggccctgccggtattcaaaagagtctgctgggccgcggccaggaacccccggaagatgttgcccgcgccaaagtggagccacaccggcgcctcccaggtgcgggcccgtacggcagccacatcgtagcggggcagccggataccggcttgcgcccaagccgcccggtcctgcagaccttgcatattcaaatgtaacatgtttgcgcctctctcatcacactctggtatccaccagatgcttgcccagctttttctccagcatgccctgaatttgggtcaggaccgtgctgaaaatcaggtagacaaaggcggcctcgatatacagcagcagcggctggaacttgaccgcgttgatggcctgggcagtctggaagatctcatgaacggtaatggtcgccaccagggaggtgtccttcagcaggctgatgaaggagttacccagggagggcacggccaccagggcggcctgggggacgatgatccggctcatggtctgccacttgttcagacccagagccctgcacgcctcattctggcccttggggatggagcccagggctgcacggatgacctcggagttataggcgccctggctgatagtcagggccaagatggccgccgggatgggatcaaggatgatgcccacataggccaggccaaaaaagatgatgaagatttgtacgatcagcggcgtaccgcggatgacccagacatagaaccaggaaatggcttttaagggcttccatttggacatccgcatcagcgccaccgcgaaggccacgaccagtcccaggataaacgaaacgagcatcagaggtaccgaaatggtaagaccggccttaaagagcggccagaacgaatcgatgagcaactgaagggtattatccacagcggcccgcctcctttagaaatagtgttcatagggccgggggaccgcctgcggcggccccccggcggaaaagtgctggggtcagcttacttctgatagatgctggtgctgtcggccacggactggccaaagtactgaacggtcaggtcgtagcaggtgccgtcatcgatcatctcctgcaggatctcgttgactttctcggtcagggtgtcggcgcccttctggaaggccactgcggactggatgatccactcctcgccctcctcgggctcatagatagcggcaatcttcacgttcatgtcggggcgctccttcatgtactcctctacggcggccacattgttgacggtggcatcggcgcggccggagacaatcagatccatggcggcggtgagggatgcgtcggacagctccgcgcccgccttgcgggccagatcaccggcggtggagttcagggcgttggcgcagctcctgccggccaggtcggcaaagctggtaatctcctcgttgtcaccggccaccaccaggcagaaggggttctcggcgtaagcaatggacatgttgtacttctcctggcgctcgggcttggggttcacgccgcagatgatgcagtcatagcgtccggagtccatgccggcctccacaggatcccaactgctagagatctggaagtcgggctccacgcccaggcgggagcagatctccttggcgatatccacctcaaagccggtaagctcgccggtgccatcctcgttgtaaacgtagggcacccagttgccctcagcggcgatggtcagcttgcccgcgtccagaaccttctggagggagtcgtcggccgcgggagcctccgtgccggggacagccgaaccggtagcgggaggattggtgtcagggggcgtggagccggagggctcactggggctgccgcaggcggccagagagaggaccagtgcaagagagagggccgcaggtacgagtttcttcagcttcatttgattcaccttttccttttctgatttttattgaccggcggagacatctgccggaaaataacgtcaatcgtcctccacaaaccgctccagaacccgaagattccggcggtcggcggcatagggatcggaaaaatagtgctcgtcggccacctcctgcaccagatatccggtatagtggtggtcgttcatggtctgaatctgctgggccagggcggtgttgccatccccccagacgttatgcagccagggatctccatccaaaaagtgcatgtggatcagctcggctccaaaggcccggaaccagtccccgagagtctcacccgccgcgccggtggcaatgttgtccaccatcatcttcaggctggggtgtcccacctcccggtgcatccggcgggcccgctccaggttgcagaccaggttgctctcgtcgtcccggagggactccatgaccagtgtcactccacagggctgggccacctgacacagccggcccaggtgatcccggcagcggttccacatggcggactcgtcctctccctggtagccccaaccggagttcaccaccacccggtcggcccccagctcggcggccagatggatggcgttggaaaaatatcgaaaggagtactccaggtgggcgggctcctgggcggcatactggtactggtaggcaatgctgggggcggtgaccgacaccacccgcacgccgtgggccctcagcttggccctgagggcagagacatcgtcatagccggtgtgatccagccagaagtgggcggcgccgcaccacagctcaatctgcccgatacccaggcgctgctggcaatccaggaagaaatccatggaaaagcggcggtagtgctggttcatgttgaccaactgactgcgtttgatgcctctcattccgcccctcctctcaggacctccagggcccgctcctccggccaggagggccggccggcatagcgctcccccggcagcagcagggacaccgggccggcatagcccgccgcctccagctccgcccggtagcgctccatgggcagcacaccctcgccccaggcccgccagccgtggtagtttccgtcgcacaggcgcaccaggccggtgtgctcccccaaccgctcgaaccaccgggggatgctgtcgccccaagtgctcataacgttggtgtccaggcacacccccagggcagggctgtccacccggcggagcagctcggagagctcctccagcctgcccagcacaggagactctgcaataagcggggtctccggccccatgaccggagccagcaacaggcgcacacccgcggcctccgcctgaggacacagctcggaaagcagtccggcggcgttccgccgcagagcctccggctctatatcccagcaggcccccgccgcccccagcaccagccgtccggcccccagctcggcggccagggcgatgcatacccggtagtagtccaaggtggcctcccgctgccgccccggcggagcggtgagggagtagcggtaggggggcggcgtgagcacccggacaggaagccccgcctccgccaaggcggccctgaggggagcggcggactcatgtcccgtgtggctgcaccagaagtggggcgtctgtggcacgaaatccacgccgtccaggccaagccgtacctccgcctccaaaaacgcggcaagcgggacgcggctgtacgggccgttggagcccaaaaggggccaggtcgccctcatggcttacttaatctcgccgggatacccgttctcacacagctcaaaccacacataggcgaaccgctcgccttcggcgcactcgctgccgtggtgggagccgtggggggtgaatgtgatgtcgccgccctccacgtggatcttttcatcctcagcggtgtaggtgaaggaggctccggggagcatgatgtaccactgctccagctcgttgtggatatgctggccgatgtagttagggccggtgccgaagttggcgcccatggacaggcggcccaggttgcggtgctcgatcatcatcatctgctggatgtcggcgccggtaaaatcctccttgtagtgccacgcctgggacacgccccggaaccggggcagggtcaggtgggcctctttcaggcaggtcttgtcgtagtcgttgagctcggtgacgaaatggacgatctccatgcactccttggcatcggccgcacagtggaaggtgaactgctccttgtcaaagtcgggcacaaacacagagacctccgtgatgttgaacacgcggcggggggtggcgatgtagcccttgccggcggtgatcagaaacacctggttgtgctccgtcttggaatagagggcgggcgagagctccgcgccgggctgaagggagatgcgctccactgccgcatccttgtaggcgccctccagaacaggcacccgggacaccccatcggtatactcgtggcggatgtcggcgcccttcgaaattttaaccaaagccatggtacattcccctttacaataaattaagcctttgagtcaatgtgaattggcttacttgatctcgccgggataaccgtcgatgcacatttcaaaccagatgtagtcgcactgcctgccggcctccaccttgcttccgtgccagaagccggtgggggtgaaggacaggtcgccgccggtcatctttacttcctcgccgccggcggtatagatgaactcggagccgggcagggggaaataccactgggccagctcgttgtggatgtgctggccgatctcgatggggccggtgccgcggacgcagcccatagacagacggcccaggttgcggtgctccagcagcataatggaggtggtggtgtcgttatccttgaaatcctcgtcgtaggtccagccctcagagataccgcggaaccggggcaaaaccatgcgggactccaccaggcaggtcttgtcgtagtcgctcagctcggtgatgatgtggagaaactccaggggctgcttgctgtccgcagagcaggtgatggtgaagcgctccgcgtcaaactcagggacgaatacgccgggctccctgatgttccacgcctgacggggggtggtcacatagcccttgcccttggtgaagataaagagctggttgtgctcggtgacggagtagacctccggtgtgatggagcagccgggctgcagggcgcagtgggcgaagtgggcctggtcaaactccccctccagcaccggcacacgggcatagccgtccacgaattcgtacttgacgccgctgtagcgggccaccttgatctgagacatgtttgcttcctccttgaatggtttgaatcagagcatcttgctcaggaaatcctgaagacgcttgttcttgggatgggcgaagaactcctcgggctcgctgtcctccacaatgcggccgccgtcgatgaaaatcacccggtcggccgcctcgcgggcaaagcccatctcgtgggtcactaccaacatggtcataccatcggcggccaacttcttcatcacgtccagcacctcgcccaccatctcgggatccagggcggaggttggctcgtcaaaaagcatgacctcgggcctcatggcgagggcccgggcgatggcgatgcgctgctgctgtccgccggagagctggttggggtaggcgtcccgcttatcctccagacccacggtcttcagcagctccatggcctggctctcgcactccttcttatcccgctttttaaccagggcgggggccagcatgatgttgtccagcaccgtcaggtggggaaagaggttaaactgctggaacaccatgcccatgcccaggagcaccttgttggcgctcctggcgtcggcgctgaccagatccacatcgtggtagaggatctgtccccctgtgggcttttccagcaggttcaggcagcgcagaaaggtggacttgccgcagccggaggggcccacaatggccaccacctcgccgggctggatctcgatgtcgatgcccttgagcacctcgtgcttgccaaagctcttctgaagccctttgacgctgatcatactcataccgtatctgccccccgtaagtgatactgctcgaaaccgaagtagtggatgctgttgcgataggatatcccggccaccagccgctccaacgcggcggggtcatcggggaattcgccgtcctccacccaccggccgataaggttgcagaggatgcgtcgaaagtactcgtgccgggtgtaggacaggaagctgcgggaatcggtgagcatcccgataaagttgcccagcaagccgcctgcggccaaggtggtaagctgggcctccatccccggcttgtggtcgttgaaccaccaggcggagccgtgctgtagcctccccgcagtaccgggcccctggaagcagcccatcagggccaccagcgcggcgttgtcgctgggctccagggaatagaggatggtgcggggcagctcccccgtctcatccagcccgtccaggaaagcagccagtgccggcaggttcaccccagggccgatgctgtcgtagccggtgtccggccccagcaggcggtgcatacggtggttgttgtcccgctgggcggcgaagtgaagctgcatggcccagtcccgcttggcgtagccccgtgccaggtgggtcagcagcgcccacttatactgccgcacctcctcttccgtcacggtttctcccgccaggcggcgcctgaccacgctatccagttcctccgggcaggccggggcgtaccgcaggttgtccaagccgtggtcggacaccttgcagccgtgctgtgcgaagaagtccatccggttatccagggcggccagcaggctcccccatccgttgatgtccacccctgcggcggcggagagccgggccagatagtctgggaagtcctccttttccacgttaaccgccttgtccggccggaatgcggggagcactttggtttccagggtatggtcggcagccagcctctggtgccattccagggtgtccgccggatcatcagtggtgcacaaaagggtcacattggatttacgcaggatctcacgcacactcaggcccccgccgatgacggcgctgcagtgctcccacacctggcgggcgttggccgccgtcaggtgtcccgtgtaaccgaagtagcgccgcaactccagatggctccagtggtacaggggattgcccaccgcctgctccacggcgccggcccaagcctcaaacttctcataatccccggcatcgccggtgatataccgttcgtccacaccattggcccgcatcagccgccatttgtaatggtccccctccagccagagctgggtcaggttgtggaagatccggtcctccgcgatctcccgcgggctcacgtggcagtggtagtccaatatgggcagacgttccgctacctgatggtatagatacctcgccgtatcactggtcaacagaaaatcctcatccaggaatggtctcatggctttccatccttcctagtccgccgtttcccgatgcgcgggcccgccggccgccctgctttccgcaggagtccaatctgttttataatatatttgtgatatatctctagcccaaaatgtagcacagttccctccatccgtcaagacataaaccgataattttgccaagatagccatttcccatcctcaaattttgtaaataaagcacaaaaattatccatttttccccactttaaagccttgacccctggaaaagatgctggtataatgacaccaacgatgttgtaagtacagccatttttctatgtgtctgtcatatatcacatagagtatcaggaggatatgccaatggcggcagtggtggataaacggcgggatagtctgtcgcaggtcgcgtatgaccagatcaagacgatgattctgcaaaaagatttgaccccgggacaattcatcaatgaggcgcagctccaggcgctgctggggcttggacgtactcccgtccgggaggcggttcttgccctggctcaggacaagctggttcatatacatccccgcaaagggattgaaatcagccgccccacgctcaaggacatccatgatatctttgaaattcgctccctgctggaacctctgattctccatcagtgctttcaccaggtggatctccagtgggcggtggacatgcgcacgctgctgctccagcatcaggacgacgaggccggaaacgcgggccagacggctgcgccgcttattgaactggataacgaatttcacctgaagctggttgacacacttcacaaccaatatgcctcccagctcatgcgcagcctcacggaatatctcaacctcatccgcatcacagcctggcgtccaagccgttatcaggtcagtaaccgggagcatattgatatcctgaatgccattttagagcgccgcccggaagatgcctgccggttgctgtccgagcacattcagctctcctatcaggaggccatcaataccatgattcactgttccttttagtgcgcaaaaatccccgccgcagagaatctgcggcggggatttttatctgctcccatatcggttaaagagtaacgccgtccttccagatggcgatctcccgatagcctgcggcctcagcacgggtgggggcgccggaggccgtgtccagcaccagttggagcagcgcctgaatgtggggctcccaagcgtccccctgggccaggccgcctgcgtcgtagtcgatccagccggccttgcggctggccagggcggtgttggtggccagcttcagggttggcaccggcgcgccgaagggagtgccccgcccggtggtaaagaggatcaggtgggcccccgccgctgccagcccggtggcggacaccaagtcattgcccggtgtctggagcaccgtcagcccccggcggcgcacagtttccccgtagtggagcacatccgctatgggtgtgtttccccctttctggacacagcccagggacttctcctccagggtggtgatcccacccgccttgttgcccggcgaggggttctcatagaccacctgcccgtggcgggtgaagtagtccttgaactcctccaccagcgcgggcagggcccgggtcaccccctcgtcggcgcagcgccggaacagcaccccctccgccccgaacatctccggcacctccgccagcagggcggagccgcccatggcgatcacccggtcggtcacccggcccgccaggggattggccgtgatgccggaaaggccgtcggagccgccgcatttcagccccaccaccagctcatcggcccccaccggctcccgccggtccgctgccgcccggtcggccagctcccgcagcagacgctccccctcggccagctcatcctccacggcctggcactccaggaaagccacccgctggctgtcccagcggcccagccgctcttgcagcacggcaatgctgctgttctcacaccccagccccagcaccagtacacccccggcattggggtggcggatcaggccgcagaggatggccctggtgtgctcctgatcctcccccatctgagagcagccgtaggggtggaaccagacgtgtactccgtccacccgccccctagcatagtcctccacccgccgggccatggaccgggccacgccgttaacgcagcccacggtgggcacgatccaaagctcgttgcggattcccacccggccgtccgcccggcggtagccctgaaaggagcggggccgcaggggggccggggccccaccccccacctgagcctggggagcgcccgccccatccagccgggtagccaggttgtgggtgtgcacccactggcccggctggatctccgtcctggcccgtccgatgggatagccgtacttgatcacatccgccccagcggggatggcggttagtgcgagcttgtgcccctggggaatgtcctcccgggtggtaacggaagccccctccaccgccacgcggatccccgccgccaccggctccagggccacggccacgttgtctgttggcgcaatacgcaggcagcggctcatttcagcgcctccttcccgcaggcctccagcgccgcggccatgccatcggcccggatgcgggccatggcccgccccgcggcggggacgaagccgggcagttccgtcagatcccggccccagaagtccaccctggcggcaaaggcggcgaccagcgcctccggtccgtccgcctggcgccgggcgaagaaatccagcacagccggctcgtcccgcactgggcacccctccccctctccccggctgtagagggcgcagagggccgcaaaagaaaataccagccggaggggcagcgccccctgccggcggtggaaggcctccacgctgggcagcacccgcgcccgccacttggagacggaattgagggcaatgtccaccaggcggtggtccacgtaggggttgtcaaaccgctcctccaccgcccgggcgaagtcctcgcactccgcccgggggagggagagtgtggggataatctcctgaaacagcgccccatccaggaagttcctcagcccccggtccgccatgcaggtgcgcaccagcgtgtgcccggagaggagggccgccggggtcaggacagtgtggcccccgttgagaatgcgcaccttccgctcccggtaggggcggtgatcggccacaaagcgcacgggcagaccggcctgctccgccgggaactccccctgcacccactccggagcctcaataatccactgggcgaagggctccgccacatccagcagcttgtcctccaggcctgtggcctccgccaccgccccggcctgctccggggaatagccggtaacaatgcggtccaccaaagtgctgcaaaaggcgttctcctcctccagccagcggaaaaagcccgcctccagcccccagtcccgggcgtggcgcagtacgcagtcccgcagcgtcccgccgttgtccgcaatgagctcacagggaaaaatgatgtaccccggcagtccggtctggtagcgttcccacagcagccgtgcgagcttggccgggaaccctgcgggggggcggtcgtccatccggctggacggctcgtagacgattcctgcctcggtggtattggagaggataaagcgcatattcggattatgggccgtgcggagaaaggcgtcatactcctcaaacacgtccaccgcccggctgatacaactcactatccggcactgatccaccgtctccccgttgcgccgcccccgcaggcagagctggtagagcccctcctgatcgttgatgcggccggtctttccggcagaggcggggggaaccaccactaccttaccctgaaagtctgtacgttcgttcatcacgtcaatgaaatgttctgcgaatccccgcagaaagtttccttcaccgaattggagtacccgctcaggggcctgccgcagcaggtatccgtcatatctcccctgttccagcgccgtataagtgagacgttccacaaaaaccctccctattatccagatgtcccctatgataatataggcacttctgtttgtaaagagccccaccactaatgcgggtctgaaaagcgtctacacgctccaaacgtccataagccgctcatcaaaaaaagcagttgactgggtggacaccaggaacgcaatccgggacgcaggggcacttgtcagcgtggctctccccaggcgcctgcaccaacgcggccaccacctcccagcgccatgcggccggggaatgaggggcgtccgctctcggttagctccggaatcctgtagggttcacggtttggggtagtgccagaatgcaaagaaagccagtgaataaatttaaaatctgacagaagcagccggaacacacacatcccggctgcttctctctggtttcaaatatagtatttataactttgacttccgtacaagtaagagccatctgtcaaatggagcatctgtggaggctgtcctatagaagcagatgataaagaaacaaatttaccatttgccttcctcggtcagatctgctttccccagggagcgccgatatcctggacacagagctttcccccgctgacctcgattgcggcgccggtgatgaatgccgcagcatcggacgccaggaaggtgtaaacacgagatacatcagaagggactccgaagcgctgtagcgcaatctgggcacacagcttttcccggttggcagcgatacgctcggccgcaattggcgtctgaatcaggccgggcaccacacagttgaccctgatacccaagggggccagctcaccggcagtcgtcttggtcatgttcacaatgcccgccttggtagctgcgtaggcaatcttctgtgtggcaggaataagcgccatgtaggatgaggtattgagaatgacgccgccgccagtccgtctcatgtagtcgactgccacatgggtaccccaaaatacggaagtcatgttggtgctgataacaaagttccagtcctccaccgtgagctccaggaagggcttggtgatattccctccggcgttgttgatccacacgtcgatacggccaaactgctgaaagaccttctcgcccagggcgctgatatcttccggcttggatacgtccacgacttgggtgtggacctgaaagccctcggcctcgaaccgcccggcggcttccgccagctttttctcactgcgtgaggcgatggtcacctggcagccctcccgggcaaactccatggcggtttcctccccgataccgctggagccgccggtaacaacgacgacttatccgttcagattgagctccataacaatatagactcctttctgcaaatgttcaaatccattttttctaaatccactaaacagcaggcagaatacccagttggagcagtacagcacaggcacaggttgtgacgatgggaatgaccagacagaccatggcataagaggggtaagactggcggtgattcaggcggcacacctgaaggttattgacaaagccgctgacgtggggcatggagtccagtccgccggaggacatggcgccaatgcggtgaatgacgttgggagacaagccgagccccaggaagtaatcctgcatgttttccagagcgatggaaaggccgccggaggaggaaccggtgaggccggccgccacgttcacggcgataatcagcttgaaaatggccgggcccgggatactggtcagagagcccaggatcagttgatagccggagaccgcagccaccacgcctccaaagcccactacagcacatgtggtaccgatggtggaaatggaattcaccgcgccggctgccagagtggccttgaggttatccaggcggcgcaggatcaggccgaacaggatcagacataccagaatgccgcaggagagggcgataaccgcatgcagcttgcagacattgagcaccagaagcaggacaaccggaggaatcagggccagcagcagaggtatgccgacctggctttctcctgcggcggctttcttttcatcctcatcccggtaggcggccttgactgcttcgccggaggggcggaagccctcaccccgggcgcgggcacgcttgagtataaaggctgcccagagaacacacagtaaaatctggatagcagcgccggtcaggccgatggcggcccccgccattggcgtagtgcccagatactgcgtgggaataatgttctgaagcgctgccgtaccggggagcatggtcatggtaaaggtagctgaaccgatgccgtggaaggtaaggtagtgccgccaggggatgtccagctcctcaaagagcttgcggccgatggagatcagggtgaagatgacgacaaacaggctgacgccgccataggtcagaaccgctacaatggcggtgatcatcagaccgccgaccaactgcttggttcgctggctgtgaacgtggttgaccacgcgcagcatggagtaggcgatggtgtcggccgctccggaatcgcccatgagctttccaaagacggcactaagcagaaagatcataaaattattttttgcaaagtcagcgaacttggtcatataggagtctataatcagcggcagaatgtcggtgccggcaaaaacggccacaaccagtgcggcgataacagaaacgataatgacattatagcctttgaatgccaggaaaaccaagatgaccatgcccaacaggataccgatcaggctgataacgctgggggacatacaatcactccttccgtggtaatgcgctccttcattctctttgcttttgcttctccgcaggcctcacatgacggtggtctgcccataaagatcgcccagggtatagccctccgaacgtaccgcgccgacgatccgcttgactggcagactgcccagagcctgtgccacatggtactgggtgggcatatcctcccaggtgggtatatgccagcgcacctgaccgcccatataggtcagctgatccgccggatacttctttacgtcgtcaggcagcttggctgctttcggattcaggcagacatattccgcatccgcctgagtgaagccgccgccggtacgcgggatgtacttatagtgcatgatgccctgactatccgggttattcagcacccgtttcagctcctccagattctccggctggcggttggcatcaaactccagctccagaaagcggaatccccaggaggtcagctccgtctttgatacccccccgtacgtatggatgtcgtcgatggaggcaaatatcttgctgtaaccgagctgctcccggccggtaataatggggtcggcatggttttcccacataaccagaagcaggttgccttccaccacccccttttctccatggaaacgggtgggcacagagacgccggtaaggttgtatccgtgtccagccagccaagccacgtcccgcagcatgttcatattgatgatgacgtagggggcagccagctcgaaccgctggggcaggacagcggacagggcctccggatcactttcgtagacaatagtatgtttggtcagtcgcgtagcttggtcatagataaagcgattcccctctttgttctgtcggggagttacgcagggcccgaaatgaaccggcatttggtacatcaggctgtcgttgcggacgtaggacataggttttcctcctttttgtctctttcttattgcaactccggcaggacaaacagagccaggttgccgaattccgctctacggcggccctcctctatgtcagtaattatcttcactaccaggtcgttgaacggggtgggaacaccgtacttgcggcccatggcgccgacataaccgttaatcatctggatctccgtctttttcccccgctcaagatcctgcaacatgctggccttggcggtgcgtaggggatagtaattgcggtagatgtatcccttggaccgctctaactcctccttcgtttggaagtcggcgatctctgcggtattcagtccgttggtatccgttagctggaagcccgcggcccgcgctgcatggaccacctcagccgcaagataggaggtgcaggccagcgccttttcactggagattaccgactcaaaggtacagcccaaggccgaggacaggccactcatgcagcagttgagcatcagcttgagccaccgggcccccatcaggttgtcggtaatctccaccttgccgttgtccatatggcccaaaacctcggccaccgctcggatgcggtcggtaatacgtccgtcgatctccccgatctcaaacagaaccgtgcgggcggagagggcgttggtcagctcggagataccgggctccacaaacgtggccccccaacggcaggctccgcctactgtgcggttccggccgacgaactcggccacagctaattccggcactccgttctgcaaggtacataccgtactgttctctcccaaatggggcaacagcgcccgaaggctcgcctcattgttggtctgcttgaccatcagaaacaccaggtcatagaccccttccatctgctccggcagcagtgcacggaccgggacagtcagctctgcacagccaacaacgccggcccctttttcgttgagtgcatccacctgggccggataggagtcgattagatccaccgggaacccgtttctggtaagaaaggcacccaagacggttcccattgctccagcgcccataattgccgctttcatcaattgcagtcctccttctccttgctaaaatcgtgtgacaggacataggtcgtgtctgaccaccttaggaagcaaaccggatgccagcccgtatccccctgtttttcccccctgtttcggccacttctcgaggcaaattcacgacttcccgccggaattgcacattcagggcatgacaatgcaatttttgtgcaaatgctcactcaggaatccttgtatttcaatgtgcagttccaattgcgcctgtgcaactcactacaattgtggttgattttttgccctccatttgatagttttaaaggggaaacgcataggagcagaacgcataaggagggctggaagctatggcaagcaatctgcccgggctggaaaacatcctggataatctggatgttggaattatcatctttgataacaaagggacatacctgtttgtcaataagacgctcctgcaatacacagggcgaacccgtcaggactacttaaatcacacggtatatgacttcatcgcaagcggactctacaaggagagcgtcgtagacaaggtctaccacgagaagcgggctgtcacgcagattcatgttacagtttctgccgacgggaaacaggtgggccgtctggtaaccgtgtcccctattttcaacgcgcagggtgaaattgtatacgccatctcctgccagatccaggttgatgccatgaaccagaaatacagccacgccaaggccatcaacgccattgctacaggaatacgcggcaattgggacgaccgcagagaggtgattgccaaaagtccctccatggtgggcgttctgaggcaggccgcacgtgcggcgcagagcgacgcttccgtgctccttctgggagaatccggaaccgggaaggagatcgtggcccagtatatccaccagcacagcccctacagaaaaaagcagatggtggctatcaactgcacctctctccccgaatccctattggaggcggagctcttcggctatgagaagggtgcgttcaccggggccgcctccggcggaaagatcggcctgattgaagccgccgccaacaacaccctccttcttgatgaggtaaactccatgccactgtctctccaggccaagctgctgcgggttctggaaaccaaagcggttattccggtaggctcagtcaaaccgcgggccgtgaatttccggctgatctgcgcctctaatgtggctctcgctcagtgtgtcaaggagggaacgttccgcatggatctgtattatcgtcttaacgtcattcccatcaccattccgcctcttcgagagcgccgggaggacattactcccctggccgactactttttagaccacttctgtcagaaatacggtcttcaaaaggaattttcaagccgcgtctatcaaatcctgaatcactacaaatggccgggaaacatccgcgaactgcgcaaccttgtagagcacatggtggttatgagcgagtcatccgtggtcaaaatcaaccagattcccacaggcatgcttcagctggagcctccctccccggaatccggcccggaatgcctcaatgaggagtatctccgcattcaaatggcactccgtctgcatggcggacaccgcgaaaaaaccgcccaataccttggtatctcccgccggacattgcagtacaagctcaaaaaatatggcctgctgtaaaattgcacccgctcagaatttctgagcgggtgcaatttggcatatattttgcatacagacaacaacagataccacatctgttttgcagacaaaccaagcttgaaaggatttgagaaacaccatggtagaacttctaatccgccccacgcttcaccgctttgagacctgtctggactttgtaaaggaatttcatccgggagaacgggatctggttctgactaataaatacatctacgagccctacctcggccagatgggacttccggttcacaccatctatcaggaggaatacggcgccggagaacccaccgatgtgatggtagacgccattctggccgacgcggccagaatgggctgtacccgtgtcattgccattggcggcggcacagtgctcgacatcgccaaggtcctggcagtctccagcggcgagggggtagacaccctgtttgacagggcccccgccctggataagcggcgggagctggtgctcgtccccaccacctgcggcacgggcagcgaggtgaccaacctctccatcatcgcccgcacccgtctgggcaccaagctgggtctggtgagcccggccatgtatgccgaccacgcggtgctcattccccaactgctggaggggctgcccttcggcgtgtttgccgccagctccattgacgccctggtgcatgcggtggaatcctccctgtcccccagggctaccccctacaccaagctgttcggatacaaagccatcgaaatgattctccatggctaccagcgcctcgtgtccgagggccgtgaggccctgcatatcctgctggatgatttcctggtggcatccaacttcgccggcattgccttcggcaccgccggctgcgcggcggtacacgcaatgagctatccgctgggcggaaaataccatgtggcccacggcgagagcaactacgccatgttcaccggtgtgctgaaaaactatctggagctccgccaggatggagaaattgccgtgatgaatgaatttctcgcccgccttctgggctgcggcacccaagccgtatatgaccgcctggaagagctgctcaaccagcttcttccaaaacggtccctccacgagtatggcgtcaccaggcaggacctccgggactttacccatagcgtcatcactggccaggtccgcctgatggacaacagcttcgtccccctggacgagactcgtgtgctcaaaatctataccgagctgttttgagcagcggacaccgacgggcaaccgcgccatatacgctccgggtgtccctgcgcttagaacttcagtctccagcccagtcccatacaaaccgaaagacctccgccgatggcttctgttatgctcccgaaccggaacgcaccgtgctggtaaaggagtaaagcggacggcccagcatcttttccagattgcggccgagagcgtagagcttctcctgatccacgccggtatggatacccatgccattgaccatagtgataaagtcttcggtggataccaagccggtgcggcaggtgtcaaagtagtaatcccccgcgcccttaaccggcacaccatccaaaaagtttgccacctgaccgccgatgccgcccacggtgcagtcaaaggtgcggataccagccagcatggctgcgtagtacccggcgatgcccatgccgcgaatatcatggatatggaaggagtgccgtgcggggtctgggtgcttttccaaaatgacttggaagtagtctgcaatgtccctgggtgtagcgataccgtcggaatcggagtgctctacctcgtcaaagccgatatcaaacatacgatccacaaattcgtaggcccgttcgatggataccttcccctggatcgggcagccgaacacagtgccgatgttgccagccaccctcttgatgcccatatcgtggagggccttcacgttcttctctgcctcgtcaaagagctgctggtgggtacggcgcatgttcttcatggcgtatgcttcgctggtggcaatctggcctgtgagcacccggtcgatcttggccccccgatccagcaggccgcccacccgctcgatggccttgggggtgagggccagaacggtatactccacatccacgtccttgggaagcttgagcagcagctcgtctacgtccttaaactgcggcacataggccacatggctgatggagcccacctccaggcgcttaaagccggccttgatcagcctgtcagccagatagagtttggcctccaggggcacatagtgttcctcattctgaagcccgtcccgcatggtgatgtcgataacgtcaatctgttcaggcaattttagttccatgatataactccttatgagatgggatagagcacggtccccagggcaatggagagaaacatgccggccagggtaaagacaaccgtggggaagaaaatgtacttatagctctccttgtgactttggccgcagatagtcagcagggtgattaccgcgccgttatggggcagactgtccaggccaacggaggcggcggagcccacccggtgcaggatctccggggccaggcccagggagatgtatttgtccgccatggcggacagggcgatacccaaaccgccggagccggagccgcaggcgccggccagaatggtggtcatcaggccgaaggccagcaggggcgggatattttccagactggtggcgaagtccagcagcttctgaaatccctgggaggcctgcacaaccgagccgaagcccaccaccaccgcagtgttgatgatggcgatggccgaattttcggcagagtaagagaacatgtccagcacaccgtggacattccgaaagaacagcaccacgcacagaaggatgccgcccagcatggccacgaccacatgctgcttgaacacgttgagcaggatcaggatgagcacaatgggcaggatggcgatgatcgggctgggcagccgcaccatggatgccgccttgaccaggctctgggtagtggcctcgtcctccacaaagcagtccccccgggcccgggcccgacttgcctcccacaggaagtaaacacacaccatgagcatgacagcaattccggtgatcacgcccaccagaggggccgccatggtgttggtccccagataggtggtggggatcacattgaccagattgggcgtgccgggaaagtttgcgcaggcaaaggtgaagcaaccgccggcaatcgcgccgggcagcagatagcggggcaggttggccttcttgaacagggagagggcaatgggatacaggctgaacaccaccaccagagtggtgacaccgccatagaccagcactgcgccggagaaaatgacgcccaggatggcaaacttctcccccaacagctcagccaagaatttggcaatggaggcagccgcccctgtctcctccatgacctttccgaacaggacgctgaaaaagaagagcaggaagttgtccctcacaaattgggcggcccctgtcatataggtatcggtcactgcggtcaccaccggctgaccggataggagggccatgactgcggcggcggcaatgcccaccaccacgatgttgatcttacggaaggtgagaacgatcagcagcgccagggacaccagaatggctaacatacgcgtgcctccctccggttacttctgatactgtttgaccagctcctgggcgtactccagccggacatttttttcagataccatctgctttacaattttctccagcagctctccggtggcgccggcggtggcggccaggttgcgggcgtggagggacatgtggccccgctgaatgccctcggtggccaaagcccgcatggcggccatgttctgagccaggcccacggcagcaatgatctgggccagctccccggcggtcttgacgcccagcatcttcactgccaccttggcggtggggtgaattttggtggcgccgcccacgaggcccacggccatcggcatctcgatggagcccaccagatcgccgtcggcgttcttctcccaggttgcgaagggtgagtactgtccgctgcgggcggcgtaggcgtgggcaccggactcgatagcgcgggtgtcgttgccggtggcaatgaccacggggatgatgccgttcatgatgcccttgttgttggtggccgcccggtagggatctgcggcggcaaaggcataggcggcgatcattttatcgacaaccttttccccgccaatggcgtccttcttaaagactgcgcgggcgcgggcgattcggtggtctgccaggttggagaggatacgcagctcggcgcggccgccggtgagctcctccaggaagggtgccacggcctcggccatagtgttcaccgcgttggcgcccatggcgtccccggtgtccaccagcaggtgaaccaccaccattggccccaccagggagtccagcacccgggcctccacgtccttcacgccgccgcccagcttcaccagcatggggtccttggcgttgcagatctcggcgatcttctccttgttctccaggatcttccccttggcgtagaagggggcaggcacgtccagcagttggatctgggaaatcatgacactgccggtatagtcggtagtgaagccgccgccaggccgggccatcttggctgcattggagcaggccgccaccacggatggctcctccgtaaccatggggatgacgtaatccttgccgttgattacgaaattgattcccacgcccatggggagcgtaaagcggccaattacattctcaatcatgtggtcggccttgtccatgtccagggaatcagcctccttcaggatggcctgctcctccggcgtcagtgtacagaactcggccacctccttcatgcgctcctcaacagagagtttgaaaaatccggaatagctgctgctcttcatggatgcttttgcccctttcttttaaataaaatgtgtgaaggcttgtgtttgtttggacactcacaaaaaagcaacttgcgtgccaactcctgaccaactgccactttcccttgggcccctaggaaaacaggcggggtagtcctgcgtatgatacgcaggactaccccgcctgtgtcaaatctgtccttttattggtgtcaaatttgtctcttgtgccatttttgtcacggctgagtttccgaccatttgcggtaaaatgtgcgccggctgatgcccagccggtgggcagtctcatccctgtctccgccgcactgctccagcactgcccgcagcaactgtccctcaaaacggatggtctcttcccgcagggttccatattgccgcgtatctgcgggctgggccgcctcaaccggtctggcgatcgtgcccagagaaaggtcggccgggtcgatctcctcctgaccacacagaatgacggccgactcgatgcagttttggagctgccgtacattacccggccaatcataggacagcagcgcctgtgcggcccctcggctgataacggccgacttctgatatcgttcgttgtagcggtccagaaagtgataggccagagggagaatatcgccctgccgttcccgcaacggcggtatggagaggggcaccacattgaggcgatagtacaggtcggcccgaaaccgtctttgttctatcagttcctccaggggctgattggtggccgccacaattcgcacatccaccgccacgttttcttcccgcccgactttctcaatctcccccccttgaagcacccgcagcagcttgctctgcattatcaggggcatatcccccacctcgtccagaaagagggtacctccctgggccagctcaaacttgcccagcttctcccctttccttgcccctgtaaaggagccctcctcatagccgaacagctcgctctcaatgagcgcctccgggatggcagcgcagttgaccgttataaaaggcctatttcttcggggactggcttggtgaatcagctttgcaaagccctccttgcccacaccattttccccccgaataagcaccgtcgcgtcggttttggcggcggtgacagcacgggacaaaagagtgcgaaattgaggatcctgtccaatcatctgaaacctggagagctctacatccaactggctcgtcaattcctcggccacctgggtgatccgttccacttccatgccaagacggttgagttccgtcacatcccggaagatggagaaggccccggccaccacaccgttccgccacacgggaaacatacgcatagatacatatttccccaccgatttgatgcggtgccactttcgggcgtcgggctttccgctctccagcacccgaagcagcagagcatccggctcaatgacatgcatatcccgcccgatggtcttgcgcatgggtactccaatgatgcggctgtacgcctcattttcatagcaaattcgaccttcccggtccagcactaccacgccgtcctcgatggcgttgagcagttcattcaggtccagctccaccgcacggcggaccagaaaggccagttggctgcctgccagctcccccaccttatcccccagttcattcacaacctcatagaccacgccttcatccaccgcctctggacgcagatgatgaatctccgtctcctggggtaatgatggttctaagcgttcgggcccgacattggttttcatgatctcccgcagggtcatcgcgtcccaccccctgttgccgcgtagattcgtgcctgaaacggttttgtatattatatacttctttttcagagaaacgcaactgttggaacaccgcatgctttgcaccaaaataatgccggtgggaactggatgcagtgaaacgctgaacggggcacttgaagtgcggcaagggccccaaatcccatacgtcggcctcagtctgagggcaaggtcatacccatgacagggagttttgaacggcagttgacctcgtgtgggccagcttggcctgcgaacagactcaggtggtctcctgaagcagctccggtcagcagagcccaccttagacgcttacgcccacgcaaccaccgcttgccagcgccaggcagccatggcggcattccgctctctgtcagtctccagtcatgactgctccaaaatcccgtacggattacggcttgggtaaagcccaaaaagcaaaattcagcctaagaaggggacaaacgcaaaacaaaacctgtcagagcccatggattccgacaggtttatgactgcaaagaatgaatgtatggttattcccgaagtttattattttatttattttaaaggcagatgtacgacctcgccggtggcggcggacaggtcagcggcaaagacaatttcctgagttttgaccgcatcggacatagggcagtctgtctccctgtcgtggatgatgcagtccaggaaatgggctgcctcttcagggaaggggtggtgcttcacatcaccgctgttaggggtgagcaccggcaattccatgtaatcccgctgctccgtgatctggccgggcgaccacaacttttcattccagagggtgcccttggtgccgcacaggtgaagattgaacacatagggactgatgaagtcatagctgctgcccaccttaccaaccgcaccgttcttgaatttcaggataatggagatggtaccgtcaaactcgagatccgtgcgcattttgctggactgggcgtagacggacaccacctcgtcctgcataaaccaccgcatggcatccacggcgtggcaaccgccggccagcagggagctgccccctacgctctttttgcacgtccactgatagcagggaatatcacccataacccggtggaaatagtcggtctccgcgtacttcagttcgccgatgaagtccttctgaatcttcttggcggtgacgaacaaggggttgtagtggagaacatagcccaccagcgtcttgactccggccttgcgcaccgcctcatccattcgtttcgtgtcctcccaggtgagggccaccggcttttcaatcaggatgtgtttccccgcctcggcagccagaatggtctgctcacagtgcatatcgtttggcgtgcagatgaccacaatgtctacattggggtcctttagaccttcctgatagtcggtgtagaccttacagcggccctccaggccgtactcccgcattttggcctcccccttctcccggctgcgggagacaatagccgtcacctgagcccgctccgtcatttcaaaagcccggatgtgctcgccggacacccacccggttcccacaatcatgacaccgtattttttcatcctgttttcatcctttccttccattcatttgacacagctcccgcagggtctccagcgcatggcggagggtgcgctccaccaggtgatgggccggcgggatcagctccacaatcagatccccgtcaaagccgatgtcccggatagccgccatcaccgccggatagtttacatccccgtccagcaggttggtaaaaccgttgatgttgtccaccgacatgcggtagtccttgcaatggaattccagaatccgtccgcccagggtacggatccactgctctgggtagccgaagcgccgggcgttggctatgtcgaagcagatgcccacattcttccgccccatctcatccacaaaccgggccagctccagtgggctatacagcatgttattccagacattttcgatcatcagtcccaccgacggggcatagtcggccagttcagacactctctcctgggcggtggtgtaggcctcctcgtatgccatatcctcagtggccacacccgggatcaccagagcagaggccgctcccagcacctgagctgcgtccagcatccgccggactgcatccatggacttttggacgacctccggctcccgggctgtcaggggatagatggagaagctgatgatgccgcccacgctgcatagaggaatccccacctcctctgccatgcggcgcagttggagaaactccgcctcccctgcgtgctcgtgcagcagccggttgaaatagccgctgatatccagggcatcggtgacactccccaccgccgggccgggcttccggtcggcggtcaggcagatctccatgcagtcatagcccagtcccttggcccggtgcagggcctccgacacgtcgcagggggctggaaaacagaattgattgattccgatgcgcatttgcccgctcctttcagtcctttttccacagttgctgggcagccaccactgctaatatgatgcagccctgaatgatcagcttgcccacctggctgatgcccagcatggtcaggatagccatgagcagcatcatgaaaaaggagcccagcaccacaccccaaacgccgccccgaccgccctcaatggcgttgccgccaatcagggccgcagccagtgagttcatggagtagtcccctgccagggtcagggaagcaatgttgtggtacccggtcaggatcaggccggccacagcggacatgagagcgcagaagatataggccccggccactacccggacattggcgatgccgctgagtcgggcagccttggggctgccgcccacggcgtacagcctgcggcccagggcggtaaagcgcagcaccacccacatagcggccgccagagtcagccagatcagcgtggaaaaagggatgccgaacaggcggccggtcccgagggcacgtataaagggggccgcgctgccggtcggtgagccctgggtgtaaacgtagcagatgccctcgcagatggtagtggtacacagggtcatgacaaagggggcaatctttagaaacagcacgccgaaggcgttggcagtaccaatggcaagtccgataaacaggcacaccagcagccccaatggaccattggcatcactgccctgcattgccgatatgcagaagatgtttaccatcatgacggtggcacccacggacaggtcgatgccccccaccagaataaccgccgcctgacccagggtgatgatgccgagagcagacgcttggcgtgagatgatgagcatctgctccaccgtcagggagccgggcaccagaacagcctgggcgccggtcatcaccacgatgatggccagcaacaccagcggctggagggaggcagtccccctcgagcggttcaacagcagattatgacgcacggcgacgcacctccagccgatctgaaatggagtaaaccaccatggccgcgatgagaagggctcccttcatcacgtactggtaaaattggttcacgttgaggttgttcatgacattggacagcatgccgatgaggaacgctcctgccactgtgcctgatagcagtccagtaccgcctgccagggaagtcccgccaatcacggtggcggcgatggaatccataccgtagttggccccacaggtggggtcccccacccgcattcgggaggccagcagcagtcctgtcaccgcggcacacagggccgccagcacgtatgccttcatgctggcccgggtggtcttgatgcccatagaggcggcaatggttctgctgcggccgatagcatacaggctggtgcccgtccgggtgcgatagagcaggtagcgcatcaccagaaatagcgccaccagaatgagcagcggcatactgatgatgtcccacttcttgtagatcacccgggcgaaatcggcgttgattttgccccccgccacgggcagtatccacagtgccacaccctccagaatcgtgctggtacacagtgtggtaatcatgggcggcaccttgagatagttgactcccgcaccgttgaccaaacccacgccggcggcaaaggcaaacaccactaccacacccaggagcacctgcgccgggttgtcgctgcccatgaggcgggcggcaatggcggtacacacactgatggtcgaacccacagacaggtcgataccgccactgatgatgaccagggtctgccccaggctgacgcacgccagcggaacacactgcaccagtacattggtgacattataggcggaacgatagctctccgagtacacgcacatggaggcgaacaccacaagcagcagcccgcagatggtcagcacactgcttagttggggggtggcggcaagtttgcggtggatcctttccagttgtttcataagcctactcctccgtcatgccgctggcggccttcatgacccgctcctcagtgatctcgccgcgggacagctctttgacgatcttaccctcatagaacaccagggtccggtcagacaggccaatcagctccaccatatcgctggtaagcattaaaatgccgatccccgcctcggtaagctggtggataatctgatagatggacatgcgggcaccgatgtcgatgcctttggtgggctcgtcgatgatgagcactctgggtttcgtcatcagccaccgggccagcatcaccttctgttggttgcctccggataggtgggataccaactcctccatagaggatgccttgatctggagactgtccatctgttcggccacctgggttcgctcctcgtcctcctttaccaggcccatgagagtgcatagccgccgcaaggcggccagggcgctgttcttccggatggactgggtaagcaccagcccctccccccgccgatcgtgggtgacgtaggccacgccattgcggatgcgctcggcaattccgccgcttttcagaggggtattctccacagagatactcccctgggaaaaccgctggtcaccaaaaatagctctgatcgccgtccgctggccctgtccctccaagccgcccaaccccacaatctcgccggcccgaacggagaaactcacgtgctccagctttcccgggagggtcagcccctccacccgcagcagttccgggccgaactgcacctggctgcggtcggggtagatgtcctcaataacgcggcccaccatcatactgaccatgcgctctttgtccagctccccccgctccaaggtgcccaccagcttgccgtccttaagtaccgttacccggtcggccagttccatgatctcgtccagccggtgggaaatatatagcacagacaccccctcctgccgcagttcccggacgattcgaaacagccgggccacttcgtcctccgccagagcggctgtgggctcgtccagaatcaggacacgggggctgcccagcagagcccgtacgatctccacactttgccgctcagccaggtttagttccgctaccggcctttccggctccaattgatatcccaagcgctggcagcactcccggatctcccggcacatgcctttccggtcggtgcgccccagggagagaacccgttcccgccccagaaacacattttcacacaccgataggttctccagcaggtttgactcctggtggacgaaaccaatgccctttctgtatgcgtcaatggggctggaaatttttaccggatgaccatccagccggagctcccctccgttgggctggaggttcccccccagtatattcatcagggtgctctttcccgccccgttctcacccaccagggcgtggatctctcccctatgtaccgacatggacacgtcatccagggctgtaacgccgggaaagttttttgtgatatgtaagaattccagatagtcctgttccaatacgctcatcctcccgctacgaggtgaggaaagaggcgatcaggtcacccttctcgccctttcccagtgatgccggaagccggccttccacggctatgcatgcactccggtaatgtgtgtgggctccggcctctcttcagccatcagtgatccatcagtgatctgtagctacaccctcgccagtaaggccctgagagccgtcgtttccgtttccgtacagagccacaatatcctcctcggtcattttggtgccacaccagaagctgtcagacagatcccagcgaacatagtcgtccacttggtcattggtaatggtgggaatctccacgataatgtccttctccccctcataggtaccattcaggatctccaggccaagctcggcaccgtaagcaaacagccaagttggcagggaggtggcaatgcaggacaggccgtcgtccttgtactcgctccacagtttcagaaagccgttgcagtcctcacccatcatggggatccagtcccgaccggagtcggcccacacctcgatggctgcacgggtcatatcaccgcccgaagaccagatgccgtcgatgtcatcataagcggccagcaagttttccatgacaggcttggcagtagcatagtcccagtcggcatactcggaggcaattacattgatgccggggtattcggcaaaggcatcctgggcaccctgcatgcgcagcacagcactggacaggccggccatgccatccaggcagacaatattgccctcgccgcccaactcctcgcacagccacttggcgcccacgtagccgaagtcgtaatcccgggccaccacagacacgttgtatttatcggtagcatccgacaggggggaggtacaatttaccaccacaattcccgcgtcgtaggcctcttctaccactgccgccacggattcggcagagatcggctggagaatcaacatatccacgcccttggcgatcagatcctcgatgtcggaaatctgcttgtttacgtcgttatcggcattgtagatatagtactcggagatctgctcattgttgcgcagataggcttccaactcgttgacgcactgtacgccccaggtgttgcccacccagacgttggagaagccaaccttgtaagtcttggtttcaccgtccggcgccgcggattggggggcagtttcaccagcgccgcccgactgactcgggctctctgcaggggtgccgccgcagccggctaccatcgccaggagcataacacaggacaggagcaacgcgatccactttttcattccatacacttcctttcaatatcggagcacaataacatcaaactttcttaatgaaactgctctcttattgtctatatgttacaatccacttccgatagaatcaatcccatttccggtactttttataacaattccggctggtttcttggaatttttacaggtctgtgctatcatagtacttaagcactaggataaatccttcctttatagatcaatttttgtatttttaaatatgtttttccttctttccccagttggtccccgtcagaactccaagagctctattctgtcgccgcgttgggaggtgcacgccacgaaacgttttaactgggaatatgaatttgacccctccttccccatccatctgttcccctatcaagtgatgggaaataaggaccctatgcactggcaccgctaccacgagatcggcctgtgcgtgggaggaacagggaaatttgtttatctgaacaaggtctaccctgtgaagccaggtgacatcttcatctctaataactacgagagccacgtagccatctctgacggaacccaggactgccgatacctctttctgattttccttccctcggctatctctgctcctggcagccaagcagtagacagccagtatctgcgttttctaaactataaccccctgagttttcaaaaccgcatccatgccgacgacccggccgccgactggctgggcgaactcatccgcagggcctatcaggtgtatgccaagcggagtcctttctaccaaatggaattggacattctgctgcggcaggtgcttttggccctgtctcaagcccgcagttcgttggaaaacgtccagcatgtccccaattttagtccaaagattgctgaggcccaggtatatattaacgaccactacaccgaacatctgactctctctcaggtggcaagccatctgaatttaaatgagtcctattttcgccatttgttcaaggatgagatgcagatctccttcaagtcctatgtcacactgctacggctggcccatgctcaaaagctgctgatcgcctcccagcggagcatcaatgagattatccaagaggtaggttacagtaatattacacagttctataaaatttttgagttaaactataacttgaccccggcggagtatcgccgtcgctatcgggactcctatgcagatgccccgcctctgtaagcctgcctttcgccgcttgctgtgaatgcgctgttttttaccacttggcgggatagcggagcatttaacttgccgcgggcggtcgttagacagcttttatgggcagaagcccgtatccacctttggctgagggctatattgacaatctaggcccaatattgagaggtgcccgctggagaagctctacaaggaccttctgcccaggggacggatagaacggcttgagcgcaggaacagcccagaggcctgcgtcccaagatagtacaaaatatccgccagatcacttcctctgtaatgaacttggtcagagcgcaaaggctggtccccgccacctcgccgaaaagctggaccctgcccaggctggagcaccagacgatgaagcctctgtcgttaaagcacccccaatccctcctgcggaaagcaaaaaagggcggcgtattggtacccagaaccagctactggactctgtcggtgaggactgccgggctccaaatgggaatgcattgatttggagaggggtgacctccgggttaagcggcagatcacccgtatcaacggagataaggaaaccgaagtcctgccggtgtgccggcctccccggacagtgttctgcatatgcttcaccaagtgctaaagcgggtggggctgtccggggacttctctgcgtggtttaccccggaaccctgcgcccatgtcaccacggtctcccagcgccaggcggccaaagccacgtggagactgctctgaaatcccatttgggtcagacaaaaacggaaaggaatcaggccgcgaaagaaaccccgtcagaatctgtgaattctgacggggttctgctttttgagaagggctataaacgttttttgatcattccaaggagtgccgatacttaagcgccaaccagacagcaggagcattcaccggctgctagttgccactcaaataagggggtgcaacagcacgggtatgttcccagcattaactcgtgatgaggcgtttcattcagacaaacatggggataaaatacaggccgagacaggtgatgccaatccagaacacgcagataaatgccataaagccccatacatccttcagcttcatgccaactacggacagggcagggatgacatacaagggctgaagcaggttcgtacactcatcgcccagtacaaacgcattcaggcagttgaccaggtcagtaccgggtatggcctttgcagcctccacaatcagcggtccctgcacggtaaactgtccgccctgagaggggataaacagatttaccaggcaggccgacaggaaggtaaagatcggcatggtgtgggcggtggcgacagacgtgatagcattgaccagcacagaacccaagccgccgtccagatacatcatgcccatgatagcgccatagaaggggaactggaggatgatatccgtggccagatgcatggagtctgtgtgggcctccatccactgatgcggctcagggaagaggaagcagttgacacccacaaacaggaaaatcacaaaattcatgttcaggcttcccagaaaccccttggtgacaaaggagtagacggcatacgcaaagatgaaggcgccgaccagccacataatggggcggaacgtgttcatcttttccgcaggggtttcggcctttttggtgctcttatagctctttggctccacatcagcctgggtggctacatcgcgcagctccaccagctcgtcttcgccagggcgggtaaacacgacaataacggtaaatgcgattgccagaaccgtaaacaggatgatattcatggggttgtagcaagtctcagccacactcatggtctggccgacaatctgagcataagagctgccctcagtagccagattggaatacagggtggtggaaggccccaggcactgacccagaatcatgcaggtatatccaccagccaccatcatggggaagtgcaggccgcgtacatgcttggcaagctgcatggcgaggatgggagtaactatggtgcagaaggcatagttcatcatagaggtgacatagccgaagatcatcatcagcaccagtgccgtagtccggctgtgtaccatgctggacatcttgttcagcagacggttcacctggggactgcgggcgcaggtggcgcacacgacaaccataatgcccatctggaaagccaaggtaaactggctgctcaggccgtcccaccatcccaccagaagctccagcgggcttttgccgcacaggagaagggacagcacgaacacaaggaaggtcaagatgatacagaacacaaaagagtccggaataattttctctgcggcgaaattgaactttttgctcatacgccacagcggagtgcccttcagttgggctgctgcttggggctgtttcgacatgggatcgcttcctttctcattctctcgttctatctatggcatgtgagtcgcggaacacactttccttactttccgtagagcatccgaatcagatactcattgagctcggcgttggactgggcgacctgctcaggcgtccacttctggaagccctcgccggtcttgaagccgatcttgcccgcatcgcggagctgcttgagcaggggggaaggctcgtgggagtcctccagatcccgcaggatgtagtcgtggatgttataggtcaggtcggtacccaccatgtcggcgttctccatggggccgagctggggcagccgcaggccgaaggagtagcgcaccgcctcgtccacggtggcggcgtcggcgatgccgttctccacgatggagatggcctcacgccacagggcgtgctgcatgcggttggcgatgaagccgggcacgtcctttttgcacagcacgggcttcttgcccacggagcgcagcacctccatcaccgtctgggccacctcgtcgctggaggcgtcggacttgaccacctccaccagggggatcaggtggccggggttccagaagtgagtgcctacaaagcgctcacggtgcttcagctcggcggagatctcgctggggctcatgacagaggagttggtgcagaagatggtgtcggggcggcagcgcgcctccagcttggcgaaggtctcccgcttgatcttcatgtcctcgaaaacggcttcgatcaccagatcggcgttcttcaccagatcgctgtcgatgtcgttggtaaaggagatgcgggagagacggtcgctcagctcctgctcggtgatgacgcccttgtccaggagctgcctggtgttggtgcggatgcccgcctccacatcagtggggtacagatcatacatacccacctggaagctggggttggacgcaaacacataaccgatgttcttgcccatcatgcccgcgccacagatgagaatgttcttgatttctttcatgctgctcgacttccttttttcacttcaagcccaaaatcccgcgggcctcggcgggggtggcgacctgcttgccgtactcctcgatgacgcggcgggcgcgctccacgaactgcacgttgctctcggccagaacgcccttggcgtacatcacgttgtcctccatgcccacgcggatgtggccgcccagcgccacagcgccgtacagcatctccaacgcgcagtggcccacaccaaagcagctccaggtggagccggggcacagggactccatggtttccttcataaagatcaggttcttcagggagccggggatgccgttggcgcagcccatgcagaactggaagtgaaggggggccttcagcacgcccttcttcaggtagtaggcggcgttggcaatcatgcccgggtcaaaggcctcaatctccggcttcacgccccactcctgcatgttcttgcccaactcctccaggaaggcaggagggttgaggaacagggaggtgtgcagccagttcatggagccgcagtcataggaacccatctcggggcgcagctccttcaggtggatctggcgggtggtgtcgtcggcgtggatgtcgccggaggtggtcatgttcaggatgatgtcgcagtcggggtggttggcgcgcagcagctccacggtcttgcggaacttctccttgtccatggtgccgtgcccctcgtcgtcccgcatgtgcaggtgggcgatggccgcgccggccttccagcaggcgtacacgtcctcggaaatctcctccggggtcatgggcacgttggggttgttggccttggtgggccaggcgcccgtagtggccacagtgatgatcgtcttgttcttcagctcgctcatggttttgcctcctcctacaaatttactaatttacttccgcaattttcgtgccaattttatatattccttatagatttcccggaatctactgagccgcaaggaattatagcggtacaggagaaggaggagagagaagggcctggtgaaaataatcaccaggcccttctctctcctccctatacaacccttgtactttatccacatgtagaccagaaaacttgggcaagttatgctgattatataaattaaaaaatgttatattccttgagtcggaaaaaattcaccatagtggtcaaaaaaatcaccgttttgcggagctaatccccagtctcttacatttttttacaagagtagaatgctctacccccaggctggccgccgccttgcgaagggaaccagtccgctccagagctccgaggatcaattcacgttcaaaggtctgtagttgagttttgaggctggccctcaaagggccagcctccggtaccgcggtaccggaggctggccctcaaagggccagcctccggtaccgcggtaccggaaaaattcagcgccgacgcaacctggcagccaccaatttcacccacactgtcggtaaccaccagccgctccaccagattttccagctctctgatgttgccaggccagtcatacttggctaactctgccacggcgtttggggagagttcggtctcttttccgtatttacgccgatacagctcacaaaagtgcctggccagtaccggaatgtcctcccgacgctcccgcaggggcttgagttcgataggcaccacactgagccgatagtacaaatcctcccggaacctcccctgccgcacctgtgtcagcaattccttattggtggctgcaatcacccggatatccaaatctatcgtcttgctgccacccagacgcaccaggctgcgctcctgaagtacccggagtagcttggcctggagtgccatgggcatatccccaacctcatccaaaagaagaactccggtattggccaactcgaacatgcccgcttttccggttcgtttggcccccgtaaaggccccctcctcatatccgaatagttcagactccaacagttcagcagggatagcagcacagttgagtttgataaagggtttgccgcaccggtcgctgttctgataaatctcgttggcgatgagttccttacccgtgccagattcccccgtgataagtaccgtgacatccgtcggcgcaactttccgcacaatttccatcacttcccgcatggccgcgctgtggtagatcgtctgcttatcgcccgcctgctggctgcggagataggccagttcctgaactgctttttcctgcttttcctccagagccaatagttgagcctccagccgcttcagctctgggaagtcccgtgtgttggttactaccagcctgatattcttctcctcgtcaaacaccggcgtccctgtcaccagtacttctttattcaaacgatgaatcgtggccacagagttgattctcttgccttgagccagcacgcgttccgttacagagccggtgtaaagaattccctccgcctcaatttccgataccttccgccccaacagctcctccgggaggattccagttgtacgggtataggccttgttaatgaacagaatggtacccgtaccgtcggtgatgtgtatcccgtcgtaaaggttttcacagatacttttatagtccccgctttccagttctgtcagatgaacaacgccttttcctgattgcatggccacctaccctttccgctaatcaccgcattatctaggtatattattatatcatacttttaaattgtgcgaaatgcatgaaaccataatcactatttaaaaaagcattggtttgctctaaatgtctgacaaatacattatgggggtgacagcaaaggcagggaatcctgctgttcgcctgctttcaaaagagagccccgcagttcaccttgctgaaatagcactgcttccgcttgcacaggcgcgtttgaacctggtcaaatagcgccttgtcaataaccagccgcaatgcgcaccagcccgccacaggctgctttgtggacggatgggtactgctctgcatctttcttggccgtctttgatgcggacttgtgtcctatcgcagctacatgagctcctccgcaagccagaaatagaggacgttccgccctgttacccatccgatatccgcacaccttatctggtagccgcgcaccaccaacaccaagtcacatccggggctgccgcagtagttcacgccggcacacacggcctcccgcccccttacgctgtggttgtgggtggagcggtttacccgctcgccggtcagcttggaggcggcagtcatctgatcccggtattccggcctctgggccaagccgcaggtcatgcgcgcgctgtttaggttggaccgaagaatggtggtgtccaccggtggacaccaccattcttcctaaataaatacacctgtatgttcaggtttaagagctcccgggcttcgtcaggggtggcggcctgcttgccgtactcctcgatgacccgctttgcccgctccacaaaccggacgttgctcttagccggtacgttcctgatatacatcacattgtccaccatgcccacccgtctgttttccgtcccgcagccgggttttacagctttgctctcctccgctattgcattttcggaacaagcacacctgcttgtacccccttcttgttgcatccccgcatcatcgcagtgttaggtgggaggtttattcctaaaaatcaagcaaaattgttggcatctgacttgcagtttatattcaaagaaccaatcccaccacaccttgagaggagttattctgtatgaatcatgttgcaatcgtatccgcctgccgcacccccatcggcaccatcggcggtcagttcaagaccctgaccgccctggacctgtccatcccggtgatgcaggctctgatccagcgctccggcgtggaccccgccctcatcgacgatgtgatctggggctgcaactaccagcgcacctatttggagaacaacctggcccgcgtggccgccatcaaggccggcctccccgacacggtgcccggaatcaccgtccaccgcaactgcacctcctccatgtcctccattcagttgggcttctatcagatcatggccggggaggccaagtgcattatggccggcggtgccgactgcatgagcgccgctccctttatggtgtttgacgcccgctacggcaagaagtacggccacatggagctgcgggattccatgtgggactccctgaccaacctgggcgtgggcccctctatgggcatcactgccgaaaacgtggccgatgcctacggggttacccgggaggacatggatcagtatgccctccgctcccagcagcgtgccgccgccgccattgacgcaggcaaattcgaggaggagatcatccccatcaccgtccatgacaagagggagaacaccgtcattactaccgatgagcacgtccgccgggacaccaccctggagaagctggctaagctgaagcccacctttaaggccgacggccgggtcaccgccggcaacgcctccggcatgaacgatgcgtcctccggcgttctgctaatggaggaggagctttccaaaaagctgggactgcccatcctggcccgcgtagtcgctgtggccaccaccggcgtttcccccgacctgatgggcatcggccccatcagcgccacccagaaggtgctggagaaggctggcctcaccgtgtccgatatcgacctcttcgagatcaacgaagcctttgctgcccagtgtgtggcctgccagcgcaccctgggcatcgacgaggacaagctgaacgtcaacggcggcggcatttctctgggccaccctgtgggcgccaccggcagccgtctggtggtcaccctgctctacgagttgaaacgccggggcggcaaatacggcctggccaccctgtgcgccggaggcggcatgggtaccgccgtgcttatcaagatggcctgaccgtgatacttccatgaaaaactttaccttttcctttcccacccaggtaatcttcggccgggatgcggaaacccatgccggggcgctctctgccccctttggtcccaacgtcatgttgctttacggcagcgatcgcatccgccgcagcggcctgctgggcagactcaccgccgatttggaggctcacggccttacggtcaccctctttggcggtatccaggaaaacccggtcctttccactgcggaggaaggccggcggctggccaaggaaaaaaagatcaccctgctgctggccgtgggcggcggcagtgtgatcgacaccgcgaaggccataagcctgggtgccaaaaacagcgtccccctatgggaactatacagcggcaaagcccaaactcagcgggccctgcccatcggcgtggtgctcaccaccgccgctaccgccagtgaggccaacggggtctctgtcctctgccacgatgtcctccacgaaaaggcggccctggacgagcctctgacccgcccccgcttcgcactgatgaatccagtcctcacctatacactaccgccccgacagaccgcctcctgcgcggtagatatcttttctcacgcttttgagcggtatttccacaaggggcagcagggcaccctccgcagccagatgtgtgcggcggtgatgcgcactgtgattacagagctgccccgggcgctggctcaccccgacagctatgatgcccgcagccaactgatgtgggcctccaccgtggcccacagtaatatgctggggtttgagggggactttgcctgtcacgccctctctcatgtgtttaccaccgagctgggcctgccccacggtgcggccctgggtatcctgatgaccgcatggtgcaagtatatgctcaccgatgaaaccgaggccattgccgacttctgcaccctggtttggcaggtcccctcttgtcccagccagattcaaaccgcccaaaacggcatctccgcgtttcaggacttcctctgctcgtcaggccttccggttacacttcgggaggctggtttgtgcgacgtttccattgagcacctggcgcggctggctttgcccgatatggcaggaacgctgggcggcaacttccgggccttggactacggcgcggtagtcagcctcctacagttggcccggggatagctgttgcaaagcaaaaatgcctgttgccgccgtgcaacggatgcgtagctatccttttgcccagggcctttctatcatgtaattttatcctattttattggcatcaactttgctcttaacctatttgttgaacgaaatggagagagaggaggcaagtcttgccgccggcgcaagccggtacaacagagccaaggctgaccatctacagtacaaaagaggagtgagtaacctatgagtaaaaagagttcccaaatcgccagtgaaaatatgagcatgaagttctccaaaggctggggcatcatcctgtaccaggccctgatgttcttctttctgatcggcttttccattgacggcctgaacatcgtagctcccgccttcgccgagtccaccggcatcgcctacgaccaggtgctgggcgtggctacctgggccggcatgatcggtgttgtagcctatattctcatcgcccgcatcaacgtatccgtgggcccccggctgctgtccggcgtctgcctgatcggcgccggcctgtcctacatttttctggggcacagcaccaccctgaccacctacttcattgccctgaccctggtaacctgctttatcaacggcgccgcctacatcgccggcaacaccctgattgcccagtggttccccaagaagaagggtctggccaacggcttcaccaccatgggccataactgcggctccgccttctatgtgcctctgatttccttcaccatcggcgctttcggctttgccaacggcatgagctacgtggcggtgggggccatcgtgctgggcatcatcggcctggttcttgtccgcaacaccccccaggagtgcggcatgtatcctgacaacgtgacccgcgaggtctatgagcgggagtacttccagggcaacagtgaggacaacggcggctggactgccggtaagctgctgaaaaccaaggagctgtggctgtgcgccctcatcatcggcatcaaccagctggtgaccaccggcgtcatgagccagctggtggtccgcaataccagcttgggcttctctcaggaggccgctgtgggcctgatgacggtgtgcgccatcatcggcgtgtgcggttcctacctcttcggcgccattgaccagaagttcggcgtcaaaaaggccattatcctcttcctgatctggtactgcatcgccttggccatcaactgtactgacaccacaatcggtgtgtatgtgtctgtagctatgatcggcattgccgtgggcgccgccgccaacttcatcgtgtccctgcccgcctctgtgttcggccgccatggcttcaccatggtcaactctgtgttcttccccctgatgcagattgtgctcatgaccaactaccaggttaacgccttcgccatccgggtcaccggcagcctgcggggcgcctacatcttctacatcggcctgcttgtggtcaacatgatccttaccgccatcatccatcccaccaggtacaacaaggacgtggctaccgagcaggagctgatgaagtaatccgttccccgcctatttcaatctctctctaagcagcaagggccgccggaataatcgggcggcccttgctgctttctatttgaatcagcttctgcggttttcgtagtcaatcccatactgcttgatcttgcggcagatggtagaggcgttaatattcagcttgcggctggcctcccgtagattggacgattccttcagcacctgctccagcagctttttctcaaatccagccactgcggtgttgaagtccaggtcctccggcggcagctcctccggctcctcttcctgtgcacactccacaattgcgggcgctgccggctgtggccccaggttctcctccggcacgttcagcagacctctcagcacatcgtcctcaatgcggccgataccggaactgcacaggatcaggtactccatcacgttctccagttcccggatgttgcccggccactgatagcgtttcatatagtcgatctgccattccgtcaggcaaaaggtccggtcatattttttggtaaagcgatgaataaagtgccggcacagctcctcaaaatcctctgtgcgctgccgcagcgccggcacagcaatggggatcacattgagccggtagtagaggtcctggcggaaactcccctccgccaccttcttctttaggtctgcgttggtcagtgccagaaagcggatatccagcttgatggggcgggttccgccgatgcgggtgatctcctgggactggatggcccgcaacagttttacctgtaggtccatgggcatatcgccaatctcgtccagcataagtgtaccgtggttagcgtgctcaaacaggccgaccttgcccttggtgttggctccggtgaaggcccccttctcatatccaaagagctccgactccagcagatgtcccgggattgaggcacagttaatctttacatagggcttgttcttccgcaggctgcggcggtagatctcgtccgctaccacctccttgcccacgccggattcgccggtgatgaggaccgaggcatcggtgggcgccacccggtccagcagagtgtcgatctgcttcaaggagccgtatttccctatcattccctccgacagatgcttgtctgagtccgtggtgatggtcttggggtggatggcattgatttccttaacaaatgcctcaaaatcctcctgcaacgagctgagcgtcacgatgggccggctgcaagccactacctggcgtaggctgccgtcctccttgaagatgggcgtccccaccacatagcccaccaacggctccccggtcttgtaagtggtggagagccgaaaggcgctcttcccactctccagcacactggtcaccgcgccgccggtaaacagtttgtccttgccaatcaggctacggacatcccgattaagcacgtcctcctctgtaatctctgtgttgcgggtgtaggcagggttgatgtacaacaccgtcccctccgcatcggtaatcatgatgctgtcatccagcccgtccaccacttctttaaaatcaatgccccggtcatgaaacgcctttaatcggacgtcaatctcctccaactgttcaatcagttccggtcgctggctttgctccattactgctctgagaagcctccgcacctctcgtatggccgaatactggttcattacgtttctcctttatccatcttttccatcggtacaaaggcgttcagaggttcagctccctgatttccgcggtcccctcccgctgtacgccacaggcatagcgatattccagatagccaaaacccagaatcaggctgtaataccggaccagtcctccactgtcctcactcccgttatgagtggatcacaaggatatggggcgcagtgacaaaaaacatgacgccgggattgcgggcccggctcttactccaactgcttttcccagtcgcttttgctgatgctgccagggtagagccgcctgctctgccatgcagtgctgacagccgcagcagccatcccccacacacaacgccgtcggccttctgctttatggccggcaatcccgattcatcaaaatacaggatcactgaagcgcagggctggatgcaccgggcacaataaacacacttgtgcgaatcaaccttaaaatgaaagccttacataggccctccttgtgtttcactaatttaacagcattacaactcgtttgtcaacgctcctccagaaaaatcacagacagggacaggattccacataaaacctattttaggaacaaacagaaacttctatatctttctgttttttactacttgttttctcaccggcgctgctgttgcatatttgcaataacagcgccattcactgtcccaatttgattccattttgcaacgccagattaaaataagccgtttgtagccttgtttaatgctcaaatatttggcacgtcgtttgctttattcttttcgtaaggacgcagtaaccatagacgccctggataacaaacaaagaaatgaggaaagtgacatgggcaatatcaaagcagtttttgtaggcaccggtatgatcggcgccggcttggctgccaacgccatgctgaacggttatcagacggttctctacgatgtggtgcctcatgagaaaatgcgccagaacatcagccatatcctggatatcctagttggggctggcgccgccaccagagagcaggccgatgccgcactaaatgcctgtcatttctcgaatgacctggaggatgccgtgaagggcgctaatttcgtgcaggaatgcatccccgagcggctggaattgaaaaaatccacctatgccaccattcagaaagtcacgggtcccgacgccattatatgcagctccacctccaagctcttccccaccaagctccaggagggctccctctatccccaatctatcttggtgggccacccctataaccccgcctacctgctgcctctgatcgagctgtgcggcggtgagcagaccgcccccgaagccattgaaaaggccaaggagatttacactggcatgggtaaggtggccgtggtgtgtaaaaaagagatctacggctttattgtcaaccgcctttcctgggccgcactagatgccgccaaggagtgcgtgcgggacggcgtctgctctgtggaggacatggacaaggcaattatgttcggccccggcatgcgtatggcggtcaccggccagctgctcaccatcagtctgggcgtggaaggcggcttccgggccattgccgataaatacggcgaggagtcaaccccctggaatgaggtatacgcccaaggggttgacgaggagatcgccaaccgggatccctccattggcaacacggtcgacagtgtgtgcaaattccgggattacgccttcgccgagctgctcaagcttcataagctactctaagtttgtttcagcgctgcaacaagcaattgtgtattgtcctatttctgcaacaacacgccccaaatccccctgcaatttagcaaaaagcggctcattacacttggcatcagccttgcataatccattgatggaaatagagattaccaagaactgaagggagaactgagtatgtctgacaagaaagcgctggttgctctggccaaagaggccagtattcaggacagcgtcaccaaggtctttgacctgatgggcggcgtaacaaacatgatcaagcccggcaccactgtaatgctcaagcccaacgccggccacgcttcccccgccgatacttcggtctgcaccaatcccgaggtcgtccgcgcagtcatccgcgaagtcaagaaagccaatcccaagagcattgttattgccgaggctgccgccatcggctgcgataccatggaatgctatgaggtctctggcatagccgatgtggcccgcgaggagggcgtggagctctacgatattaaggccgacaaggacctgatcaatgtggctgtccgcggctaccgctccaacctccatcatgtcaagctgccccgccgcctgctggaggccgatcatctcatcaacctgcccatcctgaaggcgcacgccagcatggtgttctcctgcgccctgaaaaatattaagggtgtggtgcaggatgctgtacacctgcagatgcaccagcagaatctgaccatggctatgatggatgtgtggagcgtgtgccgcgcggatatcaacatcgtggacgccatccgtcccgccagcggctactccccccacacccccgttcccattgaagtgggctgcatcctggggtcctccgatcccgtggccgtggacctgatcgcctgcgatctggtcggcatcgacgccgaggcggtggattacttccgggtggctgccgagaccggactgggtatcaccgagcgggagaacattgacgttgtgggcgccaccgtcgccgaatgctataagaaaatgtgggttccctacatcggtgatatgagcacccgttggcccgagtacaaggtgctgtgtgatggcgcctgctccagctgtcaggcgttgctggccatcaacatggagactctgaaggccatcggcgactacgagcgccgctccgacttcgtggttgtggctggcggaaaaaatgaagtgcccgacgaggtacccgacgagaagctggtgctccacggcaactgtacccgcaaatacctgaagaagcaccccaacgccatccacatcgagggctgccccccctctgagcctctgctgtatatgtccatcagcaacggcgagctggtccacggcaagggcggccagatgagcgagtacatccgtccccgtatggctgccgaccagcccgtgtggcgtaagtacgtagaggaacaggctcagaagttctacggcagtcaggaaggttgatatggcttttcaatatgtggactacccccaggaaatgaaggacctgctgatgcaaatctttgacgattccttcatgcaggccaatacccgtttccagtcctttgagggctttcgctactccagcgctgtctttgtaaactggaattccgactgtctcatctatgacgacgcgcttttggaccgtttcgtgcaggagagcacccgcttttccacctgggatgagatgatccagaccgccacagatcttcattttcagcccgccgtctgttcctgattttgttacaactcaattttaatcataaagaaaaggagtcttatactatgggcaagaccgtacttgttgacctgtcccatcccttcggccgcggcaatcccctgtggccctccaacggcgacttccacatcgaccgtgtgcagcacatgcccatgcactatcgtctgcttcagaccttcaacgacttccacatgcacaactccacccacgccgactccccctcccacgtgattcccgagtctccttacacccacgagctgcctctggagaactactatggccctgcggtctgcctggatatccccaaaaagcactgggagctgatcaccgttgaggacatcgagaaggccgccgccaaggtggagggcggcatccaggagggcgactgggtcctcatctgcaccggcatgaaccagcgctggggcgagaacgacgactacttcatgtactcccccggcatgtccatcgagggcgcccactggctggtggaccacaaggtcaagggcgtgggcttcgatctgcaggcgctggaccacatcctctatacctacgcggcccagcacggccccggcccctacgtcccccgcatcgtggacgagtacaagaaggagtttggtcatgagcccatcgaggactaccccgagtgggagccggtgcataccatcctgctgggcaacaacgtcatgggtattgagaacctgggcggcgacatcgagaaggtgaagggacagcgcttcatgttctgtgccttcccgctgcgctggtatatgggcgacggcaccatcgtccgcgccgtggccatgatcgacgaggacaagatcaataaggacgttcccgatcgcgtttacaagtacggcgtgtattgattttgactgcgcactcaagaagacctgctgcatgaatgcagcaggtcttttttcacttcccaggctccccccggaattcttatgaaataccggatgctccagaactgctttatccgcctcagtctgttccggtacttcctcatgcagtgctccattatcagctttatgtgtactctaatccgggtctatcaatgtgtttagactgtactaggtggtactcgaaccaacggagatgccgctccaataccgcccccacagttcccggccctcctgggtctctctggtgtgttgtaccatgcaggtatagacgggctccgcagccagccagccccggcgagccagagcttatagacaggctcccagcccgtcatgtgtaaacttctcccggtacttgcgaatcatctcatccgtaatgcccatctgcctgatcaggatttccgcatagcccatgccattgggaagcacacggtatctattttctacccgaatcccggcacataacagtccgccgggtccatggggccggtggttcggttctgtttcccggtcagtttctccatcggttcgtcataaacgagccgaaccgcggcccgttgtcgtacggataagttatttttcggcccagtgtataaaaatatccagaaatattcctcacttaatgagatttagagtttctatttaataaatgtctctatatgaaataacaaaatagaaagctgagaacagcaaaaatatttagaatttttatttctctttttacagcggaatatatcaagttatatagattggttccttaatctcactgagctataatttgcgacaagaaaactcttctttgtatatattaggacataaactgctaaaatattcatgtttaaacttcttccacataataaagggggaatgtaaaattacatccccctttttgatatgcctggctccttattgcacaggtggcagacatccagtatgaatttttgacatgctatagcatcgaaaatatgattggcagaaatgcaaaatattaaatttaggacgccgccgggacggcaatgaactaaaattttgcaatttaaggcaaaaagaaaaaccctggaaccattgaagttccagggtttcttatgaagtgccagatcaatctggatatttacaacccggaagctccggccttctggccggcggcgcctttgcgccgtacaagcgttttcgccgcaagcgaaaggtcgtgtcaagattttttcgcactttagtttgcaagctctggcatgaatggagtcagccggcaatggaggcatcctcaatggcggcctccaggtgcttcatattcatgtactttttgttgccccactgggagccagctacatggcgtagccgggcacagaccagcataagggcagagttgccgtccgggaagctgcccactacacgagtacggcggcggatctcccggttcagcctctcaatgacattgttggtgcggatacgggtccaatgctcactgggaaaatcacaataggtcagagtctcctcgatgctgtcctccaccttcttagcagcctctttcagcttcatggaacacagctcctccactacggccctggccttttcacgagcggcttttttgctctcctgggcgtggatcgccttgagcattttggctaccagtttcaccttggagcgaggtgtgacagagaacacattacggtaaaagtggacggtgcagcgttggtatttggcttcagggaacacttcgcccacggcctccagcataccaaggcacttatctccaacgatgagtttcacgccgtccaggccacggccacgcagccactggaagaagttgatccaactggccttgtcctctttcatgccctcggcggcacctaaaacctcacgatatccgtcctcattgaccgcgattgccaccaggatggccacattttcaaactctccaccccagttgcggcgcagatagatcccatccacatagacatacggataccgcccgccttgcagaggacggttacgccaatcctcgatgtggacatacgctttcttgttcagctcactgatggtggagggagagaccttactgccccagagagtctcggtaatatcctctacacgccggacggatacgccagccaggtacatctcaatgagagcctcttccacgctactctcccggcggcgataccgctcaatgatggcagtctcaaaggagatccccttgagcttgggcatcttgagtgtgacatccccagaagtggtggtaaggttgcggttgtagtggccgctgcggtagccctggcgttgctcattgcgctcgtaccgggccgcctgggtcagcttctccgcttcggcctccagcagctcgttgagggtttcctctacgcttccgcgcacaagttccttgagctgccccttgataacttcttcgtttagctgtacaatcttttcggacatggtttgctgtctcctttcgaatggtggtgtcgcaacttcattctaccagacatctgcaaaccatgtctctttgtctttttgcgaaacttattctacctgaccaagcgaaaaccttggcgcagggcggattcactccgcccgagcatgtaaaatcttcccggtaaccaaaaaatagccacacctttcggtgtggctattttttggaagggacggttaaaatcgatattttctcgtttcagggaaaagcccctatagtgtggtacaccgaccgcgctcccagtgtaaatgggtcgcggttggaaagtagccgcaacgtttttgttttgaggaaaggctacactaatatactaaaaagataaaagcacctatgcatattggagtttcacattataaactcactatatggtaccacattatcagcaccaaatacattgcgcaaatacgtttcgaattgtgcgttaatctctacagtaactaaaatagcgagtctcttcctcggcctggaacaacacacgtaaaacaagtttcaattcctaatgtatgttgcaagttctttgccttgcagggatttttcgtctttatataatgaatcttcaaacttgcagagattccatcctctgcccatcacaaaaagaacattttcgtactcctcaccttttactccatggtctgtggagtacacggcatccggcttgaagaaattaatagcattgatgacttcaccatatttaatttcataaaactgttttagggtcgtctgctcataggcagaatcatcaccagaattatattcctccatataattttcaatatctggaggaataggaatcaacctactatcagcagctgtccttaaaatgtcatagatagttccttgtcttgcgacacataaatcacctgtaagctctcgccactgcttcttctgcctcttagtctctattggctgacgcgttgttccgagaatctcataccttcgtttcctctatttgattttttatctcagtatttttaagttgacctgcccagtatttttcaagtgcctcataaagctgtttccgacattcaagaggatagtcgttaaacgataaattcttcttttcgttaatgattgattgaagcagatgggcaactgatgtcttaccagtattatttttaccaactatcagcgttaaagatttgtctaaaacgatatctacattctttaatagtctaaaattttcaatgtgtatcttctgtatgtacatatgcctttctcctcaccagtattaaataaactaagttttctaatcgggttttcggaatggactaatccttgatgcttaatgcattttacagtatcttactttggaaaaattgcatctttggaaatgaatactggtttctgtacaatggtattctacaccattttacaggaggaatcaaatcatgcgcatcagcatagaagaaaagcactccctggttgctcgttaccaggccggagaatccgtctccgatatctgcgccgactccggcgtgcccaagagtacgttctacacatggatcaagccgtacactgtgaccatgacagactccggtcatgctgtcagccagcaggcgtttatcaaaatgaaacagaaacttcaaaagttggagaagaagatcgagattttacaaaaggtcaactgcacggtttcagcgtcgcttcaagaaaagctgcaagagcttgccaaattgcatggtcagtatagtgtccatgccttatgcgaggcgctttgtgtatcccgcggtaccttctacaaccatatcttccggcgaaaagaggtaacagcctatgataaacgaagagccgagatgaaagagcatatccaagcagctttcgatgagagccaacaaaggtttggcgcaaataaaatcgctgctgtgttagcagatcgaggcgttcggacttcgcccaagtatgtggctgaactgatgagagaaatgggattacaaagtgtatccatctactccaaacgcgattatcagaaaagtgagcggctggcaaaaaagcagaacatgctacagcagcaattcaaagtggatgaaccgaaccgtgtttgggtcagcgacatcacttgctttaaggtcaatggcaagtatctctatatctgcgtaatcctcgaccttttctcacgtaaagtagtagcccacagagtatcaccaaagaatagtacctacttggttacctctacctttcgtcaggtatatcggaacagaaacgagccccagcagctgatgtttcacagcgaccaaggcccgcaatatacatccaacacattccggaaactacttcgcataaacaaggttgtccaatctttctcgaagtccagccgtcctcatgacaatgctgtagccgagtccttctttgcctccatgaagcgggaggagatttatcggacacaatattgctctgagcgccagttcatgcaaagcgttgatacttacatagaattttacaacaccaagcgcccccacagcacgctcaactacaggacgccggataggtttgaattgctccatgcgcaaaggaaagaacggacaggctgatctggacaaagggttcaaaactgggtatttttcatttttcaaccaccaagcttgcgtcttttatctttgcgatatgaattaccgagctgtgcaagagaaaagaaaacacctgaaataccaaggctttctcccatagaataagggtaggagtattggacagtctaagaaaactgttcaatactcctacccttgtccatatggttgcgggggatggatttgaaccaccgacctccgggttatgagctgctaccggcagttcaatcctttgatttcaagtgctttccgacccttttcgttccagaaaactgccaaatcccggaggtcgtatgctgcctgctccgctgggatttttcccgttctgggtcaagtcatgggtcaaagtagcaacacgttatcagaaattcgtcactataagacaaaacaccccaacggaggcgcaaggtcaaaagaacaatggcctgctggtcataaattacattcaaaacgactgattcattgaagcacactccaataaactcctcgctttttcatcagttcatcatatgtgccggactccacgatcccccgctcccccaccacaaagatgcggtcggcccggcggatggtggagggacggtgggcgatcaggaagcaggtgcggccctccagcaggcggagggtggcctgctggagccgctgctccgtggtagtatccacactgctggtggcctcgtccaggatgaggataggcgcccggctcaccagggcccgggccatggccaaaagctggtactgcccctggctgaattccccggccgcccccgacatgagggtttggtacccctggggcaggcgctggatgaaaccgtgggcatgggccagttttgccgcatggacaacctccgcctccgtggcctccgggcgggcatagcgcagattgtccagcaccgtgccgcggaaaaagacggtctcctggagcaccacggagaagcaccggctcagtccttcccggctgtaccgaccgaggggcacgccgtccagccggatctcccccgccgtcggctcataggcccggatcagcaggttgaccagggtggtcttgcccgcgccggtctcccccacaaatgcggccacctcccctgccctgacgcggaagctcacatgctccagcaccggcctgtccggctcataggagaaggacacatccgcaaaggacacctctccccgcaccgtccggggtgagactgcacccgggacatcggggggcagctccggctcgtccaaaatctcaaagagccgctcggccccagcgacggcctgctgaatgctggaaaagagggcggcaatgctgttcaggggccgccccaactgccgggagtagcccaggaagctgaccaccagcccaacgctcaccgcgccgcggagggccagcacgcccccggcgcaggcgatcagggcaaagcccaggttgttgaccatgttcaccagcgggctgagcaggccggcgcagatctgcgccttcaccgatgtggcgcacagcgccccgttcatctggtcaaaccgcgccaacagctcttcctgctggtggtagagcttcaccgtgcggctgttggagagggactcctgcaccaggccgctcaggcggcccagctcatcggcctgccggcggtagagcgtcctgctccgccgggagatcaggcgggtgcacagggcgatcaccggcacagttgccagggccgtcagagtgagcagcgggctgagggccgccatgatggccaacgcccccgccaccatcagcaggctggacaggagctgagtcaccgtctcagccgccacggtgctgacgttgtcggcatcgctgaccaggcggttcatggtatccccatgggggtggcggtcaaagtaggacaggggcagccgccccagcttggcaaagcactccctccggatgcgggccaccatccgctgggagaggatctccatccagcggcgtcggccccagttgccgagccactgtgccgccgcggcccctgccagagtgggcagcagcactgacagagcggcacgctccacgccgccccaaggcagaaagcagtccaccgcccgtcccagcagatagggtaccgccagggccgccccggtggagagcagggtaaggcacaccaccagcagcagctccctgccccagcgggcgtagagggccaggagccgccgcacggtgccccgcccgtccctggccctggcgtgggggccgaagcgctgctggaggctccgccgctggggaggcagcacagggccgccggacgcttcaccgtgtgccatcttctccctcctcttccggggcctgagaggcccagatttcccggtaggtggggcaggtgtccagcaggctccggtgagtgcccagacccacctgccgcccctcctccagcaccaggatccgatctgccgtgcgggccgcgcgcaccttctgagtgatgtggagcaccgcctgccccggccgccgctccaatccatccagcaccctccgctcagtggccgggtccagggcgctggtacagtcatccagcaccagcaccgcgcctccccgcactagagcccgggccagagagagccgctgccgctgtcccccggagaggttgacgcccccctgaactagcacggcgtccaggccgccggcctccgccacgaagtcggcggcctgagcagtctccagggcggcacagagctgtgcctcccccgcgccccggtcacccatggacagattttcccggatggtgccggaaaagagggcgctccgctgggcggccaccaccacctgccgccgcacccgccccaggggaaggcggctcatgggccgcccgcccaggtacagctctcccttctggggctcatagagccgggcgcacagccaggccagggtggtcttgcccgcgccggtgggacccaccaccgccagccgctccccccgccgcagtgtgaaggagatgtcctgcagggcgggcacgccgcttcccccggggtaggcgaaggtcacatggcgcagctccagcaccggctcctccacgcctgtctcctccggcccctccagggttccctcctccgggagagccagcacctcctccacccgccggacggaggttctggcccggatgagcagcttgaacacgtcaatgagagtcatcagggaggtgagcatctgggtcatataggtgacgagggcggacaccgtgcccgcctctgccccgccgcaccccgccgcccacagcaccgccgcgatgcccaggttgacagtgagggtgaccaggggggcgaaccaggccgacaggagctgaagccggatgccggactcctccagctctccgttggacgcctgaaagcggcggttttcccactcctcccgccccagggcccggatcaggcggatgccgcgcagaaattcctccacggtggtgttgacccggtccatggcctcccgcacccggcggaagcgccggccgctctccgccagataggccgtgatgagggccgtcacccccagcaccaccgccagcacaatccagctcagccccatgtccagccccatggcatagaccacgctgcccacgcacagggcgggggccttgacaccaatgcgcagggcggagttcaccgatctggagagctggtcacagtcgctggacatccgcgtgaccagggcgccgctcccgaactgatccacgcccccctcggtcaggcggaggcatttggcaaacagcgtccggcggagctcggccccaaaccgctgggaggccgtgccggagcagaagttgcgcaccagcacgcacaggatgcccgccagggccgccaccgccatccagccccccagctccaggacgcggcccagttcccccgtgcgcaccccctcgtcgatcatccgcgccatcagggtgggcagcagcagttcacagttggcctccagcaggacaaacaggagggccgtcagacagtaccagcgatagcgcctgaggcagcgccagacgagggacacacccctcccccctttccggccgccaggcgggcggcctcgtccatcagggcccggacggtgtcaaatggccgggcggcctccaggctctccagccgctccctccgcagggtgagcaccggcacccccgccccggccgccgcccgcagcagctccagattctcccggttgtaggggccgatggcggccccgctgtccaccacacaggcggacgaacaggccgccgccaccgcggcgcgcagggtgtccggcgcgggaggggaaaagctctccgcctcataccggcgggcggccagggtctccgccaccgcccagtccacgtcacaccgctggaggatcccggcggcaaaggggagccccctcttttgcagggcccggaagcagggggcccctctgccttctccgggcaccacgaatacccgcggctcccctgccgcgccgcacagctccacgctgcccagcagcaggttgaagctgccgtcgtggatatcgtagagctggcggatggtgtcgtcatccagtacgtcctccggcgcgccgcagcggaagatggcgttgtcctttaccagcaccaccacgtcggccagcttggtagccagatccacctcgtggagggagagcaccacggacagcccccggctggcggtcatctcccggaggatgtccagcagctcgatcttgtggcggatgtccagatagctggtgggctcgtccaggacgatcacctccggctgctggcacagggcccgggccagcagcacccgctgcttctggccgtcgctgagttcggtaaaccgctgctcccgcagctccagagcgttgacccgggccatggagtcctccacgatgcgctgatcctccctggagagctttccgaagtggtttgtgtaggggtagcgcccggcggccaccacctcccagcaggtcatgagctccggctcgatgcggtcggtgagcaccaccgacacgtggcgggccagctccttgtcgctcatgccgtccaaatcccggccgccgatggccaccacgccgcccagctttgtcagatggcgggtgatgctgcgcaggatggtggatttgccggagccattggggccgatcaggcagagaatgcccccctgccagatgccgatatcgatgtcctcgatgaggggccggcgatggtagcccaccgacagcttctgggtctcaaaatacatcagccattcctcctgcgcttgatcatcagccagatcaccacgggggcgcccagcactgaggtgacggtgctgatggtgagctccgtgggggaaaaggccgtgcgggcgatgaggtcgcaggccaggcagaacacgcttcccgtgaggaaggtggccggtatgagcaccatgggccgggaggtgcggaagatcaggcgggtgatgtggggcacggcgatgcccacaaaggagatggggccggcaaaggcggtgacgcaggccgacaggatgctggacaggaggatcagggccacacggaagcccttgacgttgacccccatgctcttggcgtagttctcacccagcagataggcccccaggggcttggacaggagaaacaccagcaccaccgtggggatggtgatcagggcggaggcccccagggtggcccaggtcatgccggagaagctgcccatcgtccagatggtgaaattctggagctggctgctctcggcgaaggtgatcatgaagtcggtgcccgcgtcgcagatgtagccgatcatcatgccgatgaccagcagcatggctaggttctgcacccggctggacacggccagcaccagagccatggccgccagtgccccggcgaaggccgccaggaagatgacgtagggggagaagccccccgtcacaatgggggtggccgccaggagaaagaagcccacaaacaggcgggagccggaggagatgcccagcacaaaggggccggcgatggggtttttgaaaaaggtctggagcaggaagcccgcgatggacagcgccccgcccagcagggcagcccccagcaggcgggacaggcggattttccagaggatattgccctccgtggtgccgtcgttgccccagcggaggagggtgagcatgcgctccaggctcagatgcaccgagccggtattgatgttccagtaaaacagggcggccatcagtattgccagcacaacaaatcccacggcgtttctcgtgtgttgtctcataggcctctctccttttccgtgcgttcccctgccgggctccgcggcttattcggcgggcagcttatagaagtagtggagctgatccgcgtcctcggggtggtagataatggtggcaatgtcctcgatcatggtggccacgtcgtcggcagactgccagtagttcttctggatgccccagacgttgccctcctggatggccttcatatccgccagatagtccccgttggccagaatgtctgccacggtggacacgctgacgtcgctggtattgtcatagatcaggatctcggcgtccaccgccccctgatagaactcctccacggtcatcttggtgttgccgccctggccgggctccagctccgcaaagggatatgtgccgccggccagctccagcatcttgttgacatagtcgccgccgttgcgcacgtagacggtacccttgaagatataggtctggaggatggtggggtgctcgctctccccggccacgctctcggccacggcattcacccgctgcacctcttcgtcgaagtaggcgtcggcctcctcctccatgtcaagcagggcgcccaccagcttgacccactccacgcggcccagggggtggttctccaggtgctggctgtcggcgatgtaggggatgcccagctcgtccagcttggccagcacctcgtcgctgccgtgcatggtgttggcggagatcaggatgatctggggcgcggcggcgctgatgagctcatagtcgggggcggagttcttgcccacataggtggtggtgccgtcctcaatctgctgggcaacctgctcgatatgccatttatccttgtcggtggtcaccagactcaccttgtccagcgccccgatggcgtgaaacagggtggcgtgggtggtggagaagcagcccagcttggtcagcggggcctggagaacggtcatgtcccccgtgtcgtccggcgcctctcccccctcgggcacccacaggaacttctgtcccgcgccgtcggtgatgatcttacagccgttggcacagtagtccaccgcgaagttgttggcatactggagctccatgctgcgcaccacggtcaggtcgttcttgtctgccgcagcggtctccaccacgggggacgggctgggactctccggcacagtctgctggccgcagcccgccgctgtgagcagcagggcggcggtcaggcacagcccggccgcccgattcagatggtgtatcattgcgattcctccttgtcatctggttcttctctatctggaaacgcggttttccacgtattccaccactccaatttcccctccagccggcaggcgtgctccagcatcctccggtgcatctggcagtccaggggggagggcccggcccgccgggcggcaggacagcccccgccgcacaggccgaaggcgggacagcgggcgcattcctccggcggttccagcccggggcagggactctgcggcagggccgtccccgcgcccagcgtccccaggaggcacccctccgccccggccagggcggagcagggccacagacggccgtccggcgtcaccgccagggagcgcccggtctgggcgttgcagtagcagtcccgtctgcagcccgtgcgcagcagcaggcgcaggcgctccagctccttgagccgcaccgggcggcccagccgggccagctgatcgtgacgggccagcaggcggttcaaaccctcggccagcgcctggggggagggggacagccccgcccccgcgccccggccctggggccgcaccagatccaggcccacaccgtggacgttgccgcaccacagggcaaagtccagcagacggtccaggccgcgcacactgcccgccgacaccaccgcggtcaggttggccgccatgccggccgccgccagggtctggagcccgcgggccgtcgcctggaaggagggctccccctccggggtgcggcgggcggcgttgtccgggcccaccccgtccaggctcacccccacggccacccgccgggccctcagctcccggcagagcgccggtgtgagcagcgtgccgttggtctggatggcggcgtggaacctccgtccggaggcccggccgaagtccagcaccttcaccgccgtgtcccagcgcagcaggggctccccgccggtgaactggatgcgcagggctccccccggcgggcaggccagagccacggcctctgccgcccgctcgggggagagatcctcacccgccggcccgctcccggcgtagcagtagccgcaggccagattacagcggttggtgaggcgcagcaccagggtgtccagcccgcccttcattgaaagccgtcctccatcacgccctccatgtccatgtagatgcgccggatggcccgcagctcctcctcacccgcctgccacataccccgctggtgggcctccaggaagcgttcgctcatctggagcaccgccgcgtcgttgacctgctccatccaccggcgggtctcctcgtccaggaggaactgccgcgccatggcgtcgtacatccagttggaggccacctccgccgccgcgtcccagccaaaaaaggtgtcaaaggtggtggacagctcctgggcgcccttgtagccgtggcgcttcaggccctccagccacttggggttgaggatgcggctgcgcatgacccgggccagctcggtctctacacgggcggtctccggtcgggcggggtcggcggtgaggcccgccacggagacgggcctctgcccgctgcagtcccggacgcaggcgatcaggccgccatgatagctgtaaaaatcgtcgctgtccagcatgtcgatctccaccgacgactcgttcttgatggtcatccccacggaggacagctggctgcggaacagctccggcatggcctggccgtggaagcggctgctgtacccgtgggcgctccagagggtgtagacctggctcagatccctccagctctcccagttctggctgtggatggccttgctcacccctgcgccgtaggtgccgggtgggcagccgaacacccgcagggatgcttgctccaacgcctcattttcgctcaggccctcggccaccagccgcttccgctcctggtcggtgtgctttttgacaaagttctgctccgggggctcatccaggccggccacggccagcaccgcccgctccaccagctccaccacgttggggaaggtgtcccggaacaggccgctgatgcgcagcaccgcgtcgatgcgggggcggcccagctccgccggggggatgggctccacccccaccaccttgtccgtctggcccagatagcgggggcgcacccccatcagggcgaacacctctgcgatgtcctctccgttggttttcatgcactcgtcggagtagaccacgatcgccacactctccggccagggttcccccttctgggcccggtaggcgtcgaccgcctgctccgccagcgcctgtcccaccgtccatgccgcccggctgggtacggcggcggggtcgatggcgtaaaagttccggcccgtgggcaggatgtgggcattcccccgggagggactgcctccgggcaagggcgggacaaagcgcccctccacccccgccagcagcagatccagctcgtccgtggtttggcgcagccggggcgccgcctgggtgcagacaaagtccagcacccgcgccagcggggtggtgtcccccggaaagccctcctccgccaggagctccgccgcagcctccggccggtagccctccgccgacaggcgggcaacgagccgccgggccgtcgcaatcgccccgtccacaatgcgcagggcggtgcgcccgtcggggtagagcctctccggcgcggcccgcagctcctcgggcgcccacccctgggccaggagtatgctgtcctccagggcgggtacggcgccgtttggcacccgcaccagggctcgggccaggtggtcgaagcgctccccctccgggggctggccgtagatgtgcaggccgtcccgcaccagggaggtcttgatgcggctcacccagcggtggaggcgggccaccccctcctccggctcggcctccagatccgcccgctccagctggagatcggtagtcacctccagctcctccgccagggtgaagatccgctccagcagtgcgggcacctgggcaggccgggcctggcgggcgtgatagtagccgtcgatggcctcgtccagatcggtgaggccgccgtaggtgtccgcgtcgtccatggaggggatcaggtggtcgagtatgcaggcgtaggagcggcgcttggcctgcatcccctcccccaggatgctgatgttgtaaatgtagaggtggggcatcccgccgatgcagatgtcgccgaagcagccggaggacaggccgatctccttgcccggtagccactccagggtgccgtgggtgcccacgtggagcaccacgtccgccccgaacacctcgtccacccagcggtaaaaggccaggtaggagtggggcggggtgctgtcggtgctgtggtagagctcctccgcccgctccggcgccgagcgcatgggctgcacccccacaaagaggctgccgtttcggataccggggatgacgatctggctgccggacaccatcacggtgcccggggcggggccccagctctcctccatctgggcccgggtctcggggttaagacggtcgaaccacccccgatactgctccgccggcaccgtggcctccgcccgctccagcgcggcctccggggagagccagcggttgtcgttggtcaccgccgcccggatgcgggcaatgatctccgccccgctggaaaaggagtaggctgtgcgcaggccctggttctccagggcccgcaccacccggaataccgtctccggcgtgtccaggccgtgggcgctgccgatggtgtcgctgcggggcggcatgttgtgaaagatgacggccacctttttctccggcatgggcttgcgggccagttccgcccagcggcaggccagctccgccaccctcgtcacccggtcgggcagggggaggcacaccttccgcccgtccgccgtccgctccgtcaccgcgtagggcacggaaatgagctgcccgtcaaactccggctggtagacgcacacgggcagggagaccagatccaggccccggatatcccgccggtactcgtcagcactgaagtaggtggtgagtccctggatcaccggcaggccccagttctcaaacacgctggcgggcacctggcccgcccgggcctcccgcccggccagggtggtcaggctgaagccgtaggacaccaccagcgcccccggaatgggggtgccgtccgccctgcggtagaaccgctccatccggtagaggatgccctgctccgtcccgtggtcggcggcgaaggagtcggacagggcgtatgggacgcccccccgggcctgaatggcccgcagcagggcgtccacatgctccagattgccggttctggcgtagtggtcatggatcagcacaccgatgaccggccgggtctcggcggccatccgtgcccggtaccccgcctccctctccggcggcaggaagccctccagggtgtacaccccctgcccccggggcgggctcggagggctgaggggataatccccgccgaagcggccgttgagggcgcagagcaccagcccctccagatccgccgggctccccgcctggtaatagctgtccagcgcggcgtagagggccggctccagccccagcctggggagcagctcggccagctcgtcccccatggtggaagtaaaatagaccggccgcccctccagcgcctcccacagccgggaaaagcagtacaggttctgaatcgagccatgggaggccagaaaggccatgtccgccgccgcgccgtcggccagaagggcccgctccagcccggcgtcggcatttatctcccgcacggagtagaccctgccctccaccgcgccggggtaccggcgctccagggcggccagggcctgaggcagggcccagagccggtattcattcatgagcacgaaaagcagctttaccatagacgcctccttaacccgccgccgggctgtggccgcgcaccagctgggccagcggcctggcccgcagctcctccacccggtagcagggcgcacccatcacctgggccacctgagccgccagccccagagagacaaactgccgctcggtgtcgatcaccaccgctgggatgtgggcctccgccacccgccgggcggcccgcagggcctcctccaccgggtcgccgccccggctgaaattggcccggccgtcggtgatgagcaccagcaggggcagggaatcccgcacccggcggcgctgccgctccagcatgcggcgggcctcctccagcccagcggccagcggggtccgcccgccggtggggagggcctggagctcccgctgggccagctccacgctgcgggtgagctccagcacggcggcggcctccccgccccggaaggccaccagccccacctgatcccgcttctggtaggagtccatcagcatggagagcaccgcctccttgacctccttcatccgcctggccgcacccatggagccgctggcgtccacggcgaacacgatgtccgcacccacgcggctttcccgcaccttcacccgcaggtcggggggcaggatgaccaggccggactgcccgccgccccggctccactgatagggggcggcggcccgcagcgtggcgcccaccgccagatcttccgccttcccccgggggatacggtcgcccacggcccgcccccgccgggtggcggagcgggtcttgctgcgccgcccgctgccccggcgggccaggcggtcggcccgggtggtgagcagggttctcacctcgtagaggttctccccctgctccaaccgctctcgggacggcccctgctccgtgggtggcgcgggggcctgaaccccctcctgcggcggcccgtcggcggggtgggactcgtccgccggtccatccccgcccccggcctgtccgtccgctccagatccccgagggggctcctcccctctctcctgtcgcgggggcgggccttcgcttccctcccgcctacggtggggcagggccagctccgccgccgtgtggagatcctccaagttgatgtaagtgcgcccggccaaggcagccagggcgcgggcggtgtgcaggatggccagctccgcccggtgcccggcggcgttggcctgccgggccaacaggcaggcggcctgctcctccgcctcccccacgtccacctggggcagcagggcgcgggcggcggccagctgcccggccagccgctcctcccgccgggcccactgggcgcgaaaggcggcgggggtttcctcaaaggccaagcggcggcgcaccacctctttccgggcctccggctcccgctcccccgttaccgccacatagaggccgaagcggtccagcagctgggggcggagcgtcccctcctccggattcatggtgcccaccagggcgaagcgggcggggcaggtgtgggagatgccgtcccgctccatccggcacactccggtctccagcgtgtccagcagggcggcggtcagggcggaggggagcagatttacctcgtcggcatagagtaccgccccgtcggcccgggccagcaaaccgggctggaaggttctgcggccggtgcgcaccgccgtctccagctccacaccgcccagcagcatgtcctccgtggcgcttaccggcagctccagcaggcgcactccctccaggccgcccagggcccgcaccagagtggacttggccgtccccttttccccgcacagcagcaccccgccgatgcggggctccaccgccaggcagaggagggcctgctttgcccgctcctgccccaccacggcggtgaaaggatacaggggcctatccatagaacagcgcctcccagtcgatgccggcatctccagcctgctcaaacggggcccggcgcaggcggtggggcagggccagttccgccgcccgccgcagctcctccattccggcctccgtccggccctccagagccgccagagcccgtgccgtcttgagcatggtgatgtccgcccggtggccgtccacctggagagcggtgcacacccgggccacggtatcgaacaggggctcgggcagggacacctggggcagcagggcctgggccgacccgatccgacgccggagggcctcctgctccggcgcccagcgggcgcagaaggcggcggggttttcctcaaaggccaggcggcggcgcaccacctccttgcgggcctccgcctcctgttcgccgtgcacctccaccatcaggccgaagcgatccagcagctggggccgcagatccccctcctccgggttcatggtgcccaccaggatgaagcgggccggatggctgtaggagatcccctcccgctccacggtgttgacccccatggcggcggagtccagcagcacgtccacaatgtgatcctccagcaggttgatctcgtccacgtagaggatatttccattggcctgggccagcaggccgggctcaaaggcgcggacgccctccttcagcgcccgctccagatccagggtgcccaccacccggtcctcggtggcgcttacggggagctccaccactcggcggcggtagggaacggcgcggcgggccgggctggaccggcactcgtcgcacagcgcctcaccatccatccggcagtggaaggggcacccctccgccacctccacctcgtccatcagctctgccaaaccgcgcaccgccgtggacttggccgttcctttctccccctggatcagcacgccgcccaggcggggctccaccaggttgagcagcagcgcggttttcagcttttcctgccccaccagggctgagaaggggtattcgtatcgttccatttgcgcatgaccgcctttctgtatcgggaagatgaacgcaaaaaaccggggtcggagcgtgctccgatcccggttttcctgcaaacagttcatcccccgcctacgggggatattcctctgccgcacactggctcctgagatccgaagagcatgtcctgtgcacgcagcaggcaggttttctgactcatgcgtctccgtccacgccagccttcccggcattacctgccagtggcatttttggcgggactccgcaattacagcagcggccctgtgcgggagtttcacccggcttcccttttccgtctccacccggaggggagacgcacctgtgcgttcgctattttatttgtagcaacttgattgtattccccattttattcgttgtcaatcgttaatttcctttcggagagattttgcccattctgaggtggaggcgaactgccgtaagtgcctgccaaacgccttttgcgggcggaaacccgcacccacttctcgggagaagcgcacagcgtgcggcaaagtgcagagagggacaagccagggagcgaccgccgtcacggccgtgtcacccctgtgtgccggtttcggggcaggggtggggcagggccccctgaaacgggattttggcggcgttgggccgcgtgtgggcaagtggttcctgggcgggagtgtcacggaaaatctgccctcccagagtagcatgaattccagagagaaaaggcctccgggggcccgattctgggttctccggaggcgttcgattttagtactaggataaaggaccgacgtcggtgaaccgccgccggcccaatcacaacgccccgcagtgcggggcgtgccaaggggttgcgggatttcggctcagaccaagcttaggtggtcgctgaaggcggagttcgaagttttaggtggtcggtagtattgagaaaggcagtgttaccagctggttccagcctttttgaccgccgctgtgggggcgtttgggctggggacatccttccacgccggggtacgcaaatcctgcgccacataaaacaaagatagggtcttttgcgctggacgggaaatgatacgttgtaacaaagaaaaggcaaatgataatgttctgttaactctgcgtcgttggcctagctatttctcctcttctgcggtatgttgtgttgctgcaaaggaggtaataagccatggcaaaacgtagagccaacggggagggaaacctccgcaagcgcaaggacggtcgctgggagggccggtacaccgccggccgcgacccggagacgggcagggccatctacaagaacgtcctgggaaaaacccaggcagaggccaaggccaagctgaaacaagcaatcgaggaagcgaaaggactggacacggccaaggttggccggtacacggtggggcagtggatggaggtgtggtttgagcactacgccaagataaaagtacggccatcctcccaccagacctaccggggctacatcgacaaccacatcaaacccaacattggcaaggtccccctggaaaaactcactcctctggaattgcagaagttctacaagaagctgctggagcagggaagggcaggccggctggagtccaggcaccaggccaaggggctgagccccaagaccgtgcggaacatccaccagatcatctcctctgcgatgaacttagccagggagcagaaactgatcaccgcaaatcctgcggagggctgtgccctgccccggctggagcacaaggagatgaaaaccctgctggtggagcagctccagtccttcctgagagagtccaaggacagcggcgtgtttgagctctactatctggaattggctactgggctccgccggggagaacttctcggcctgaaatgggtggacattgatttggagcggggtgacctccgggtacggcggcagatcgcccggatcaacggcgaggtggtggaggcgcccctgaaaacgaaaaacgcctaccgcaccctgccgctggcagaggatacgataggcgttctgaaagcacagaaacagaaaacaggagacagcccgtgggtgttccctagccccaccggcaggccgatttcaccggacagcgtgctgcacatgctccaccgggtgctgaaacgggcagggctacctcgagtgaggttccacgatttgcgtcacacatttgccaccctggccctccagaacggggtggacgtgaaaacggtatccggaatgctggggcacttctcggcggggtttaccctggacacctacgcccatgtgaccacggcctcccagcgccaggcggccaaaacgatgggcagtatcctctccggcagtctccagccctgaacgctccgagatcccgtatgggtcacggtttgggtcagataaaaacggcaaaaataatcatccagaaaaaatgatgaaaacaagagaaaacccgtcagaatccatggattctgacgggtttatggttgcgggggatggatttgaaccaccgacctccgggttatgagctgataccagaggttcaatccgttgactttgggcgctttccggccctttttgttccggaaatctgccaaatcccggaggtcatatgatcttcgctccgccggaatttttcctgctctgggtcaaattttgggtcaaggtggtaaacctgcctcaaaagctgcgccgctataatcagtaaagtggcctggatcctatggggaaattcaaaggagaacaagagacaggccctattccaatccagaattttcctctgggagcggggcctgatggcacggaattacccaccttttagcgcatttgcgggcacttcccacacctgtctcaaggtggagacgggtaaacacaaaattaacagttggataactgaacagaggactgcctgtgcctgtaaggggcaaaaacaaaataagagagcagaagagattctccttcttagcacataaagaccagaaagtgaaaccagtcagcacgggaggtcacttcgaaaactccattttttcatcaattcccaatccggccagaactgtattcacatctctggtataagtgccatcctccaactgaacaagcggaaatcctatggccccggaacccctcatgccatcatataacgggctggtatctcggaaggtaataaattccttcagatggtcgatggaaccagtaacattgatgaactgcggcataataccatgtgctgtcaggatggacacaaagcgcatggtgccgggacagatgttgctgccatagacttttatggccaagactgggtcactcctttcaaaacaatcttacacagtttcacacgaaacaatttcgctatgtatcataccatcgcagccgagaaatgtcaacggcttattccacggaggctgtatgaagccctgtaggagtacaatacatattggacagaagaataaaaaaggatgaaggataaggcctcatcggttaaagttggagttgcagacaacaacttgacgagagggggccatatccttcatgagcaagagtataacacaggacatggcatatcggcaatccctgatgaagtacgcagaaaaatatggcgtcagccgggcaagccggaagtataacaaaagccggtcatatatctacttctggagggctcgctgggatggcagagcagaatccctggcctgccagtcccggcggccccacagccatccaaaccagcacacagaagcagaactaaaactgatccgggatatgcgccgccgcaatccagagctgggtatggtggagctgtggcaccggctgcggcagcggggctatacccgccgtctggagagcctgttccgggtgatgagaaagctggggctgttcccacccaaagagaagaaaccggcctgcaagccaaagccctaccagcagatgacctatcccggccagcgggtccaggtagatgtgaaggtggttccccgccgctgtatcacagaccctgagctgcgcctgtaccaatacactgctattgatgagttcacacgcctgcgcttcctggctgcttacccggagcagtccaccttttcctccgctgactttctgaaaaagctgtccaaatggtacgcccgccggggaatccgcgtggaatgtgtccagaccgacaacggttttgaatttaccaaccgattctccaacagcaagcgggatctccctactctgtttgagaccaccgccgcccacctgggtatccgccacaagctcatccgaccctacacgcctcgccacaacggtaaagtggagcgcagccaccgcgaggatcagaaacacttctattcctgccgcagcttttactccctggatgacttcgccagacagctcgctgtccacaaccgccgctccaacaacttccccatgagaccgcttagttggctttctccgaacaaattcactgtccaatatgtttgacaaacctacattattccacggaggctgtatgaagccccctgcctgatgggataagcaggttttaattgcaatttcgaagcaaataaggtagtattacaataatgaaaagaatgggagcgaatgagcatggacgacgtaaaactctcggatataattcaggatctaaaccagaaagtggatgcggtctaccgccatggcacgttgcaggaacgctattccgcgattgcccgggattacggagagggctttgtgctcacggagtcggaggcgcataccttggggtatgtctgcgagatgggagaggctactgtcaccgatttggctgactatagttttcgaaccaagggcaccatatccaagatgctgcgcaagctggaggacaaaggcctggtcgaaaaatttcaacgggagggcaaccggaagtgtatctatgtacagccaactgagcggggaaagcgggcaaacgacatccatcgggcatacgatcgggccgccaccagcgttatgctggcagatcttctaaagacttgtacaattgaggaggtggagagctttttcaaggtaacccaggccagaatcaaatatctctccaaagagcaggcctcttcagaacaataattttatagtttcatatgcaacaaaatcggctctaaattttgtgctattccacaaaatttagagctgatttatagtttgcgcctcaaaatggttgacacatttgtgataaaagtgtatgatacgcgcatagatggtttcacatgaaaccattattgagcggccgctcatgcacttcgtcactcgttttgggaaggagaagagatccatgaaaaagctcaacggcaaagacctgttctttatggccatgggctcctgcatcggtgctggcattatcaccaacaccggtgtggctattggtatggcaggcagcggcgtcatcctcgcttacctgctggcattctttgtcatgttcatagccaatctccccacaatgctgtttgccacggttcatccggttacgagccctcaatatgtcatgacctcctgggccagcaaaaaggtggccggcttctggctctactgccaggtgttcgccgcatttgcacaggcctacatgggcgtggctttcggcacctatgtaaacagcattattcctgccatcagtgtacaggcggccgcctgttttattgtcaccctgtttttcctgctgaaccttctggatctgaagagctcggcaatggtacagaatgtgaccacggccattcttctgtgcgtgctgctgtccttcatccttcttggcctgccaaaatgcgatcttgggcggatgttcagcggcgaaagtctgttctatggcggagctcgcggaatttttgacgcctgtgccaacgtgttgttcggggtgggcggctgcaccattcttatgaatttcggccctcagatggagaatccgaagcgcaatattccccgcatgacgattatcacctttatctgcgcctttctggcctttggactggtcgcctttgtgggatccggcgtggctcccattgaagaggttgccggtcagcccatgacctatcaggcccagctgatctaccccggcaatacctacgtaatttttgtcgtgggcggcgcgctgctggcgattattaccaccatcaactccaactatcagcgctattggagttccattatccgcggcgtggacgagggatggctccccgctttcatgggcaaacggaacaagcgcggcaccccttgggttctgatggtgctcttctggctgatggccctgattcccaacctgtttaacctgaacatcggccagctggtcagcctggcctccgcagttaccctgatccccatgctgattcccatctggggtttcctgaagctgcccgagggagatcccgagggctggaaggcctcccggatgtccaaatatttctcttctaccgccagcagggtggttttgtgcaccatctgcaccctgatgatcggtgtgtttgtggtgctgaacgttctgcagtttacccccgttgtcaccatctttattattgtctactttgccgtggcactgattatcagctttgcctttggcgacaagctcatggctgccggtgcaaagcgggctgcagctctccgtgccgacgagtaaaggcaggatttcctctccaaggttccgccggcaggctgggcttccaataagcctatacgacaaacaaggtcagaaagggagatttattatggtcaacaagctggaaaaatgtctgcaccccatgctcgccaaacgagatcagaagtggttctgccataaaattcaggccgaaatgcagaagcagggcctgggctacctgattctgcaggctccctacaatgtgttctatgccaccggatacacctctctggtgggaagcagtgcggcagtgattcccgccgagggggatgtccacctcctgatcagcaccctggagagcgccgacgcctacgcatccacgcaggatgtggacgtgcgggaatttatgtcctgggtattcattgacaacggtactgaggagtcccgccgggataagggggacgtgatggatcctgacgccatcattcacatctgcctggatctcatcaaaaatacccccatggatggcaaggtgggcatcgagatgggcagtgtcacgcaccatttctacaccgccctcacagaggccttgccggaggggatggtggtggatggctccaccgtcaccagaaactgccgagtggtcaaatgccagtgggagattgacatgctccgactggctgctcaggaggctgataaggcatggcgtgccatgattgaggaggtcaagcccggtatgcctgcctggaagctggacgccatgttctcctactatgcgtccaagctgaatctggaacacgggactgcctcaagaggacacaacttcatccccgcggccgggccctattacggcctgtgcgggatgccccggggctatatcctccaggctggtgatatcatcaaatttgatgtaggatatcagtatctgggctactggagtgatatcgcccgcacctttgccgtgggaggcaccgctcccgacgaggccctggagctctatgacaccctctatcgcgccaatcgcctgggtgtcagtatgctcaagcccggtgtggccatgcgggacatctacagtgccatccgggaagaggtggagaagagccgcctggttcccaagtatcccagaggccacatggggcactccatcggctgcggcgtcggcccggaggagtatcccacaatcgcccccggaaccgactacgtgctggagcccaacatggtcgtctgcctggagaccccctactccggcacgggcggcgcacccgtacacggcggcttcaatctggaggacacccatctgatcacggccaatgggcacgattcctttacgacaatgcccgacaatatcttctggaagtaagccaacccggtgccgtgtgcgtttatagacgacagtacaccggatgaaatggagaagtgttagtacaatgaggtacgattttgagacagtaatccgaagagagaatgccgggagcggcaaatgggatgaaatcaagaggactcttggctgcttcccgaaggatgtaatccccttctctgtggcggatatggaatttgatatggtgcctgaggtgcgggagggactgaaggcgttcctcgaccgcagcgtaatgggctatgcggccatgacggaggaatacagacagacagtggtttcctgggaggcgcgccgtcatggctggcagatccagccggagtggatccgggatacgccgggtgtcatcaatgcctttttcacggcggttaaggcgtttacaaaacccggcgagggtgtgatgctcatgacgccggtgtactatcccatgtatgccgccgccacccgtcatgaccgggttctggtggacaaccccctggttcaggagggggatacctaccggattgatttcgaggactttgcacaaaaggcggcagaaccgaatacaaagctgctgattctgtgctctcctcacaatcccagtggacgggtatggacgcgggaggagctggagcgtatcggccgcatctgtattgacaatcatgtcttggtggtctccgatgaaatccactgcgaccttctgatgcccggctataagcatatcccattcggctcgatcagcgaggagtttgccatgaactccattatctgtaccgcgcccagcaagactttcaacctggcagggctgcagacttccaataccatcattgccaacgaggaactccggcagcgattttacgtggagcagcaaaaggacgacggaaaccccaagtgcaatatcctgggtctggagggctgccgcctggcctatgcctacggagatgcatggctggatgaatgccttcaggtcattgacaccaaccgaaaggtgatcaccgactatctggcccgggagtttccccaggttcgggtcacaaggctggagggcacctacctgctttggatcgatttccgcggcctgggaattgagtgccacgagctggccaggattctgaaagaagaggcccatatcttcctggatgagggctttatcttcggagaggccggggagggcttcgagcgctggaatctggctgcgccaacatcctatattcaagccgcgctgtcccggctggagtgcctgaaaaagcatctgtccggaatgaaaagagagatgctctgaagcgccgaattccgcttgaaacgaggtgtttttatgctgagtgataaggagaaggctctcctgaaaaagctggagttgccctacccctgtgtggcggtgaaatatcgctttgaaaaaccggacgcgccccattacgacgggggaaaactggcctattgccagtatgtcaaatatgcccaggaaaccggtaatcacttctatattactgcagaagatgatgcctgctacggcaagatgccgctgggaatgattgggaagccgccggtaactgcgagtggtcaagccggatacgatttcggaatttacaagtctcctgttggagcccagcaactctatcagaaactgccggtactggaaccaaatactattcgctatgtggaattctgccccgctgaaggatgcgattttgacccagatcttctcttctttgtttcggatttcccgcaggcggatatcatcatgcgtgcaaccagctatatctccggtgacttgtgggaatccaaatcctcgccggttatcagttgtgcgtggatgtacgcatatcccgtcatctccggaaaggtcaatcatattacgactggcttttaccatggcctcaaacgccgcaaggcctatccggctggactgcggatgatctccattccctatcagaagctgccggaattctttgcggcgctgggggaaatggactggacaacgatcgccttccgcgaggacgcggaaagcaagagggaacttcagcgccgaatggagcattggcaggaaatggccagggcctccggaactgaagtggatctgcattagacgcatgtcccggccgggcgaggcggtcgccgtacacggccgggacatttttatcccggaattgatacgccgaagataaggagataccatgaagtaccaagaattgtttacccctgtcaaggtggggagcattacgatcaagaatcgcttcgccatggcgcctatggggccgctcggcctggctgatgccaacggcggctggaaccagcgcggaattgactactatgtggagcgggccaagggcgggaccggactgatcatcacgggcgtaacctttttcgaccaggtggtggagaagcaggatccatctactgtgcccaatccgctctataagcccgtcagctttgtcaagaccagctgtgaaatgaccgagcgggtacacgcctacggcagcaaaatttttctccagctcagcggcggctttggacgtgtgacgatccccaccaatgtgggagatattccgccgattgccccctctccaattccacaccgctggctggataagacctgccgcgagattagcagagaggagattcaggcgattgtacggcagttcggcgaggcggcctaccacgccaagcgggccggttttgacggcgtccagatccacgctgttcacgagggatacctgatggatcaattcgccatttccatgttcaatcagcggactgatgagtatggaggccctctggagaaccggctccgcttcgccagagagacagtggaggagatcaaaaagcgctgcggcgaggacttccctgttaccctgcgcttcagcgtcaagagcatgatcaaggactggcgtgtgggggccctccccggtgaggacttcgaagaaaagggccgggacgtggcggaggggctggaggcggcccggctgctggagtcatacggttacgacgcgctggatactgacgtgggaacctatgatgcctggtggtggaaccacccgcccatgtatcaggagaagggactgtaccggaaatactgcaaaatggtgaaagaagtggtctccattcctgtattctgcgccggacgaatggatgaccccgatatggcgctggaagccatccgaagtggtgtctgcgatatcatcgacctaggccggcctctgctggctgacccggactattgtaacaagctgagggccggacggtgccgggagatccgcccctgcatttcctgtcaggaggggtgcatgggccgggtggcggagtactccctgatcaattgcgcagtcaatccccaggcggcccgggagcgggtcacagcctatgcgccggtgctccgccagaaaaaggtgctgattgtgggcggtggtgtcgccgggtgcgaggccgctagggttctggcgatccgtgggcacttgccagtcctttacgagaagggctctcggctgggcggcaatcttctgccaggcggcgcaccagagttcaaggaagatgatctggccctggcgcgctggtatgccgatgaactggcgcgacttcgggtgccggtctacctgaacacagtgcttacccggtctcagattctggagcaggattttgacgccctgatcatcgccaccggctccaccccaaaggtattctccctgggcgatgatgacagggtatataccgccgcccaggttctgctgggggagaaggactgcggcagagagaccgtcgtggtgggcggcggcctggtcgggtgtgagaccgcgctatggctggcgcagcatggaaagaaagttactatcgtggagacgctggacggtcttatggcagccaacggaccgctctgccatgctaaccgggatatgctggaggccctattgccgttccaaggagtgacggttgtcacaggtgcagaagtcaagtgctatcgaaacggcgtcctgtcactggctgcggccggtcgcgggcgggagatcccctgcgacagcgtgatcctggcggtaggctaccgagaggaagattcgctctaccgggagttggagttcgacgtaccagagctctatctactgggcgatgctcgtaaggtctccaatatcatgtatgcgatctgggacgcgtttgaagtagcaaaccatatctgatttttggcattggtgctatatattgcggaggctgtccgaccataaagcgggcagcctccgctgtatgtttcagtatgcttcatcaccggctgtttgaaccaaaaataaacggcagtatggagcatttgtgggcatggctcacacccactccggcagaagaactgaacacccacaggaaggccaccgtcgcggccgtgtgggctctgtgtgccggcttgagggcaggggtggaggcggtgcacctgtcaagggcatttcggcggcattgggccgcgtgtggggcggtggctgtctgggatagtcatgacgcggcgaccctggccatccagaacattcaattccagaagaagaacgcccccaggagccccgtttcgggcccttttggggcgttcgattttagtactaggataaaggaaggtggtcgcaagcgcccacctcccggccacaaagccccgcagtgcggggcttttccggcttttgagggaggtgcaccttttcgccacagtcgatggttttaggtggtcgtcaatttgagaagtccagtgttcccaggcggttccggcctttttagcgacgctgtggcctgaaggatgcaaaatttgcgtcgcaaaacaaagaaaaaagccctttccgaagtacaactgcgatggtgttgacaatgagaagcttttccatagaggccagttcgcaaatgtgaattgtttgataactctgcgccgttgacctagctactttgtgccttttgcgatatgttgtgttgctgcgaaggagggatcaaggttatggcaaagcgcagagcaaacggggagggtaacctccgcaaacggaaggacggccgctgggagggccggtacaccgccggccgcgacccagagacgggtagggccatttacaagaacgtcctgggcaagacccaggcggaggccaaggccaaactgaagcaggcaatcgagaaagcgaaggggctggatgcggccaaggttggccggtacaccgtgggccagtggatggaggtatggtttgaacactacgctaaggtgaaggtgcggccctcctcccaccagacctaccggggttacattgacaaccacatcaagcccaatatcggcaaaatcccgctggaaaagctcacttctctggaattgcagaagttctacaagaagctgttggagaagggcagggtggatcgactggaatccaagcaccagtccaaagggctcagcgccaagacggtgcggaacatccatcaaatcatttcctctgccatgaaactggctcaggagcagaaactgatctctaccaacccggcggatggctgcgccctgccaaggttggagcaccgtgagatgcagacactaccggtggagcaactccagtcctttctgagagaggcaagggacagtggtgtgtttgaactctattacctggagctggccaccgggctccgccggggtgaacttctcggtctgaagtgggaggacattgatttggagcggggcgacctccgggttcggcggcagattgcccgaatcaacggcgaggtggtggaggcgccactaaaaacgaaaaatgcctaccgcaccttgccgcttgcagaggatacgataggcgttctggaagcacagaggaagaaaacggggagcagccagtgggtattccccagcaccacgggcgggccgatctccccggacagcgtgctgcaaatgctccaccgggtgttgaaacgggcggggctgcctcgagtgaggttccatgatctgcgtcatacctttgccaccctggccctgcagaacggggtggacgtgaaaacggtatccgggatgctggggcacttcagcgcaggcttcaccctggacacctacgcccacgtgaccacggcctcccagcgtcaggccgccaaaacgatgggcggtatcctctctggtagtctccagccctgaccgctccgagatcccgtatgggtcacggtttgggtcaaataaaaacggcaaaaataattggcccggaaaagtgacgaaaacaaaaggaaacccgtcagaatccacggattctgacgggtttatggttgcgggggaaggatttgaaccttcgacctccgggttatgagcccgacgagctaccaagctgctctaccccgcgatatggtgccggagaccggggtcgaaccggcacgggattcctcccacgggattttaagtcccgggcgtctgccaattccgccactccggcgtggagggctccagtctcttgcttttgagtgctcaattagaataccacagtcaaagcctcttgtcaacccctatttttaaaaagccgcccgacaggaatcgtatacatctttccctccctccggcatatactgatatgtacacgacttacgaaggaggtatccccatgcaacacacgcagcaggacgaaaccattctgcgcaccgagccaaaggaagacatagatgacctgattttccgcgccgatcccggctggatggtcagtgagcgataaaaccgcccgccctcgggcggttttttcctgccactctctttacaatttccactcttttggatataatatgagggctattttatggaaatgagtgtggttttacatgcttcagtttgatgaatacaaggtaaagctcaacaatctgcgcccagagctggacgagctggaccaggccttgggcctggagacggccatccgggaggtggagatgctggagtcggagagcgcttccgacggcttttgggacaacctggagaaggcccaaaaggtgcagcagcgggtcaagcagctacgggacaagattgagggccagcaaaggcgcaagacccagtgggacgacctgatgaccctgtgcgagttgggcaacgaggccgaggacgagactctggttcccgaagtggaggagggcttcgccaagctggaggccgagatagaggaggccaagctgtccactctgctcaccggcgagtatgacggctccaatgccatcctcacctttcacgccggcgcgggcggcaccgaggcccaggactgggcgcagatgctcttccgcatgtacacccgctgggcggagcgccacggctacgtgtgcaagacgctggactacctggacggcgacgaggccggcctcaagagcgccaccatttccatcgagggtgagaatgcctacggccacctcaagagtgagcacggcgtgcaccggctggtccgggtctccccctttgacgccaacgcccggcgtcagacctccttcgccgcgctggaggtcatgccggagattcccgacgatgtagaggtggacatccgcccggaggatgtcgagatgcaggtgttccgctcctccggtgccggcggccagcacatcaacaagacctcttccgctgtccgcctgatccacaagcccaccggcattgtggtttcctgtcagaccgagcgcagccagtttcagaaccgggacacctgtatgcggatgctgcgctccaagctggtggagcttcagatgcaggcccacgcggagaagatctccgacatcaagggtgtacagctcaagatcgagtggggcagccagatccgttcttacgtgtttatgccctaccagttggtaaaggacaaccgtaccggctatgagaccagcaacatcaacgccgtgatggacggcgagctggacggcttcatcaacgcctatctgaaggcggaggccaccggcaactgggctgaaaaataaattatttcctacacgaatcttttgagcagcgggctcataagattcgtgtgctttttgcacactttttttctcccccaccttgtatttttgtttccagtttgttaccattaggatgccccaaaaaacgcctttcatagggaaaggcaatgaggaaaggtggaatgttttctatgagaaaacccgcaagcaaattcctgtccctgttcctcgtgctggctatggtgtgctccctgttcggggccgcctttgccgcagaggaagaaaccgcaaccccctatgtcattcccgatgtcgatggtaaggttgttattctccataccaacgacacccacggcgcggatctggacgaggagggcacttccttcggcatggccggtgtggcccagctgaagaaggacttcgaggccgctggcgccgatgtgctgctggtctctgccggcgactccatcatgggcaagcccctggtgagcgccgaccagggcaagagcgccatcgagttcatgaacgccgccggttatgatgccatgaccgtgggcaaccatgagctggacttcggcatcgacaacctcaaggccctggccaaggatgccgacttccccatcctgtgcgccgacatgaccactgaggccgacggcaagactgtcttcgactccaacaagatctttgagatcggcggcgtgaaggtgggcgtgttcggcctggccacccccgagaccctgaccaaggccgacgcctccaagatgcccggcatcaccttcccccagaccgacaagctgtacgccgtcgcccaggctcaggtcgatgagctgaacaaggccggcgccgatctgattgtctgcctgggccacctgggcatcgatgacgagagcatcggcaaccgctccatcgacgtgtgtgagcacgtgaacggcattgacctgttcatcgacggccacagccactccaccactgccgatatcattgccaaggtgggcgacaccaacgtggtcaacggcgccaagatcgtctccaccggcaccgctctggccaacgtgggcgtggtgatctacgatcaggagaccggcaccctgaccgacgagctggttcccgccgcctcctacaccaagaccgacgccgatgtggccaagctggtggacgaccgcaacaccgccgttgataaggtctacggcgagaagatcgccaccaccgaggtggatctgaacggctcccgctccggcggtgcggccaccgatcctgttaccaaggccgagatgaccttccccgagggcgagggcgtccgcaccactgagaccaacctgggcgactttgccgccgacgccatcctgtggcaggcccgccagactctgggcgaggagaacgtggacgccgcgctgaccaacggcggcggcatccgcgaggctctggccaagggcgacatttccaagaagagcctgctggccgtcttccccttcggcaacaccgtggccaccatcgacgtgaccggcgcccagcttctggaggccctggaggccgctacctgcaccacccccgaggccatcggcgccttcccccaggtgtccgtcattgagttcaccctcaacaccggcgttccctatgtgaacggcactcaatacgccaactctacctactacgctcctgccaatcccggcagccgcgtcaccatctccacggtgaacggcgaggcctttgatcccgccgccacctacaccatcgccaccaacgacttcaccgccaagggcggcgacacctacggcgtgttcaagaccgccggcggctggaaggatgtgggcgtgtccctggaggacgccctgatcaactacaccactgaggagctggacggcaccatcaccgccgagcagtacggcgagcccgccggccgcatcaccattgtggacgagcccgccaactatcccgccgatctggagaccggctcctggtactacaacgccgccgtgtatgccttggacaatggcatcatgaacggcaccaacaagggctttgagcccaccggcaccgtcacccgcgccaccgtgtaccagaccctctataacatggagggtaagcccgcggttgaaaagaccactgtgaccggcaccgagggcgagtggtacgccaacgccattaactgggccgcctccgccggcctgtttgagggcactgagtacggcaccgacaccgtaatcacccgttccggtatcgccactattatcgccgattacgcctcctacaagggtattaccgtggacacctccggcatggctatgaaggaggctcccgactacgactccatccccgccgccgatctggagggcatgaccttctgctattatggcaaggtgatgaccggtgaccagaagggcaatctgaaccccaacggccagctcacccgcgctgagtttgcccaggtgctcaagaacttcagcgtcctcaagcccacctatgtggagaccgtggtttccatccctgtagccgcccaggacgggatccctgcccatgagattcccgccaccctgaccctgcccgtctccgcctccaaggacgcgaaggtccccggcgtggtgatgctccacggcaccggctccaaccgggacgaagccggcatgggttacgccctggccgccccccgtatggccgccgacggcatcgccaccctgcgcatcgacttcatgggaaacggcgactccaccgccagctaccgggattacaactacacctccgccgtcattgacgccaaggccgccacggactacctggccggcctggagactgtggacggcgggaacctgggcgtcatgggctggagccagggcggaaccgacgccctgctggccgcagaggcccaccccgacaccttccaggctgttgtcacctggtccggcgccctggagctgaacggcgcctccctgtttgcgggtaccagctttgaggatgcctatgcccaggccaaaaaagagggcttttatacgatgacctttgactggcgggagcccttggagctgggtgagcgctggttccaggaggtggccgaaaccaacattctgaaggtaactgctgacatcaaggcccccattctggccatcaacggcaaggacgatactaccgtcacccccgataacgccgagaagattgtgaaggccgccgctaacgccgacagccagttgctgctggtggataactgcgaccacacctacaacgtgttctctggcgatttcactgccctctatcagacggtggacgccaccgccgctttcttccaggcgcagttgatccccgctgccgcccaggccgcggcctgattgatctccccctacacaccaggcacccccggagtccaacggctccgggggtgccttcgtatttcttgcttttccgtatgccggaagcagcagctctttttagccccgtcgacaggccacagccctgcaaaaaggcccggaaccaaatcggttccgggccttttttctctctggctcagtatatgccgcccatatcgggggcagccggagcagccggagcggggggctggggcttgtcggccaccagggactcggtggtcagcagggtggcggcgatggaggccgcattctccagagcggagcgggtcaccttggtgggatcgacgataccagcggagatcatgtccacataggtctcattataggcatcgaagccgtagcccaccttgtcggccttcttcacattctccagcaccacggagccgtcgatgccggcgttggtggcaatctggcgcatgggctcggtcagggccttggcaatgatggacacaccggtcttctcgtcgccctcggtctcggccagcagcttctccacggaggcgatggcgttgacataggcggtgccgccgccggccacgatgccctcttccacagcggcgcgggtagcgttcagggcgtcctcgatgcggagcttcttctccttcatctctacctcggtggcggcgcccacacggatgatcgccacgccgccggccatcttggccaggcgctcctggagcttctcgcggtcgtagtcggaggcggtagtctcgatctggctcttgatctggttgacgcgggccttgatggcgtcggcggagccggcgccgtccacgatgatggtgttctccttggagaccttcacctggcgggcgcggcccagcatgtccatggtggcctccttgagctcatagcccatgtcggaggtgatgacggtgccgccggtcagcacggcgatatcctccagcatctccttgcggcggtcgccgaagccgggggccttgacgcacaccacattcagggtgccgcgcagcttgttgacaatcagggtggacagggcctcgccctccacgtcctcggcgatgaccagcagcttcttgccggactgcaccacctgctccaggatgggcagcagctcctgaatgttggagatcttcttgtcggtaatgagaatcagggcgtcgtccagaacggcctccatcttctcagtgtcggtgaccatatagggggtgatatagccccggtcaaactgcatgccctcaaccacctcggaataggtctcggcggtcttggactcctccacggtgatgacgccgtcgtgggaaaccttctccatggcctcggcgatcagcttgcccacggtctcgtcgctggaggacacggtgcccacgcgggcgatgtcggcggagccgttgaccttcttggagttggccttaatggcctccaccgcggcggtggtggccttggcgatgccctttttcatgaccatggggttggcgccggcggccagattcttcagaccctcgcggatgatggcctgggccagcagggttgcggtggtggtgccgtcaccggccacatcgttggtcttggtggagacctccttcaccagctgagcgcccatgttctcaaacgggtcgtccagctcaatctccttggcgatggtcacgccgtcgttggtgatcaggggggcgccgaacttcttgtccagcactacattgcggcccttgggacccatggtgatcttcacggtatcggcgagctggttgacgccgcgctccagcgcgtgacgggcttcctcgccgtagcagataattttagccataacgtattacctccaaattgagtcgggtggaactcacccggaagatttcttgttccagagagcgggcgcacactgtgcgcccctacacggaaaattactccacaatggcgaggatgtcgccctgacggacgatagtgtactcctcgccgtccgccccgcgaaacagaatttcgcggggacccccggggatttcatctgcggccgccggaaatgaattccgtcggcctccggcgcttatcgcgccgccccgccccaggcggggccccaggtggacggcttatctcgccgttccactgggttattctacgatcgccagaatgtcgccctgacggacgatagtgtactcctcgccgtccgccccgcgaaacagaatttcgcggggacccccggggatttcatctgcgaccgccggaaatgaattccgtcggcctccggcgcttatcgcgccgccccgccccaggcggggccccaggtggacggcttatctcgccgttccgctgggttattctacgatcgccagaatgtcgccctgacggacgatagtgtactcctcgccgtccaccttgacctcggtgccggagtacttgctggtgatgaccttgtcgcccttcttgacggtcatggtgatctccttgccgtccaccacgccgccggggccgacctcgatgacctcggccacctcgggcttctctttggcggcgccggtcaggatgatgccgctcttggtcttctcctccgcttcgaccagcttgataaccacacggtctgcaaggggcttgagtttcataaggggttcctccttcatgtatcattcatttttcttgtaaaccaattcagcaggttagcactcattttaccggagtgctaacctgcttataataataacctcacttgatggattccgcaagtcttaatttttaaataatctgttaaatttccattccgcgcggttcctatttcaatttaacattcaaaacctgttcagatcttcttttttctcccgctctcttctgttttctaatttcgcacccgtttctccggaatccaatgggttccttcgggaaagaaaaagtttacttttttagcagacacacggacagagagctcagaatccaccagctcttcaccgtccaaattgatccggtcggcccgctcacaggcgacgtgcatctcccggccgcggcgcagaaggatccgcgggatatccccggcgccccccttggcgtacttgccgatcagcgtcagaatggtcagcctggagacagccggcaccactacaaagtccagcaggccgtcgtcgggcacggcgtcggggcaggggttaaagcccccgccatagtagcggccgttgcaggcgcaaatgagggtaaacgcctcccccggcagacgctccccgtcgatggtcacccggtaaggccggtgaatcccctggacaatggtgcgcacggcggagagctggtaggccagcggcccgctcaccaggggcagcttcttaaagtctgccgcaccgaggccgatgcgggcgtcgaaccccaccgagcagacattgagggccagccgcccgttgcactcaatgagatccaccggcgcctggggcgcgtccagcagagcccggaggtcgtaaaagcggcaggcatccgggccgaacatccgcagaaaatcgttgcccgaacccatggggtagtgggtcacagcggcgttgccgaagcctgcggctccggcaacagcctcgttaagggtgccgtcgccgccgcaggcatagatgcgcaccggctcccccctctccgccgccgcccgggccagctcggccccgtggccggggtattgggtgaccgccgcctcccatggctcgtcccgcccggccaaggcagtgcggagcttctcccgcatctcctgggtgcggtcgtattttcccgcgtgggggttgattaagaacaggtgcctcacagggcccatcctccttatccgttggtcagctccacaggagcaggcgctgctcggtgcgggccatgcgggagacaatggctgccgcctccgcccgggtgaaggtgccctccggctggaaggtcagccggctgtccaccccggacaggattcccttggcgtagaggctgtagatggcctccgccccctcatcgccgctgcggatgtcgggcaccgacgccttcacccgggccagagagttgagttccggcatggccttggccagactggtggcggcaaagagctccgccgcctcccgccgggtgacagcccgtccgtaatcccgctcggtaaagtcccccttttgaatcatgccgctggccaggcagtaatctaccgccggcacataccagtacggtccgccttcggtgctcagatgaaagtcgtccccctggtagcggctctcaatcgtggccgccagcttgagggcctccgccacggtcaaggtctgattgggcgcataacggttcttccccacgccggaggtgagccccacattgtaggcgatgtccacccagagggcgaaccagtcctggggggacacatcggagaaggagggcagcttgccccgggtgagggggaactgggcggagggcacccccttggccgccaggatgccgggcaggtcatagaccgggattttggtgacggtgctcccgttggtgagggtgagcacctgagttccgccctgctcggccacctggacctggtcatagctcagctcatagagcacattggtggtgctccccgccccgtccgggaaggggagtatactgaccacgccccagccgccccccttttgggcgatatagagcccgcagtcaatggggagaagggtgtcgtactccggctggatgagataccgcccatcctgccggatcaccccgagcttgccgttgaggttgaccgccgcgatgccgagctggaaggacacgatgctgtcgtactggagagggatgaccacattccggccagcgtccacatagccccactttccggccagctcgcactgggccagcccctcgctgtagccccataccgtggccccctccggcgcggcggaggccgggaggaaaaacaatcccgcgcacagggccgcggccagcagccccgccagggcgcgctttccctttcctcgcctcatatcaatcccctcctcctatcttccgtactggaacaggtcgcacttgagcatgccgttatacagcttacgcttcttgtctgcggtacggccaaaggtgcgctcgaactccgtgtgggaggagagcacgctcacccgccacccctccggcagtgtgcacaccgcccggccgaaagcccggtaaagctcctccgcctcccgcttctccaggatgcgctccccatagggcgggttggtgaccacccggccatagggcgcgtcccggcggaaggcggcggcgtccgccacctcgaagcgcaccgcgtcctccacatccgccttctccgcgttggcccgggcgatggccaccgccttggggtcgatgtccccgccccagatgtcgtatgccccgtcgtactcgccgtctatggcctcgccggcggcctggagccacagcccgctgtccagccaacgccacttctgggcggaaaaggcccggttgaggcccggcgcccggtttttggcgatgagggccgcctcgatggcgatggtgcccgagccgcagaaggggtcgcagaaggggtccctcccccggtagcgggagaggagcaccatggcggcggccagcgtctcccgcaggggggcggccacccccaccgcccggtagccccgcttgtggagcccgaccccggtggtgtccagcatcagggtgacctcgtcccgcatgatggagaactggatctgatacagcgccccgctctccggcagggtttccagcccgtacttctcccccagccgggcagcggccgcctttttcagcacggcctggcaggcgggcaccgcgtggagctgggagttgagggagtgccccttcaccgggaaggccccctcccgggggataaattcctcccagggcaaggcgcggcagccctcaaacagcgcctcaaagtcggcggcccggtagcggcccaccaccagcagcacccgctcgccggtgcgcaggttcaggttcacccgtgggatatccgccggggcggccttgcaccgcacccgcccgttctccgccgccacctccggcagcttcagccgccgcagctcctcagcgcacagcccctccagcccgaacagggtggggaccagcaattccagctctctcatgtccatcgcctcgctccgttctcgttcttagacagcagtataccttatttttctctgcttggcaaatctggaaagcgaatttgcttccctttttctccgagttgtgctaggatagcagtagtatttcgaaaggaggagtgcccatgcccataccaagcatctgctggctcgccgccctcgtcgcccttctggcgttggaggccgccacggtggggctggtttccctgtggtttgcggtaggctccctgtgcgccctgctcacgtccttctttgtgggcaacatctgggtgcagttcgccgtattcctggcggtgtccttcctgtgcctggtcatcatccgccccctggccaaaaagtacgccgacccccgccgggtgagcaccaacgccgaccgggtcattggtgccgaaggtgtggtcacccaggccatcgacaacctgaaggcccagggccagatcaccgtgaacggcgccccctggaccgcccgcaccgaggagggctgccccgccatccccgccggctcccgggtcagggtactccgcatcgagggcgtcaaggtcatcgtgtcccccctgcccgtccctacgccggggcggtaattccaaaccgaggaagagaaaaaggaggaatcccgcatgccgtttatccccattatcatcattatcctggtcgtcgtgctcattctggtgctggccacaaacctgaaggtggtgcagcagtccaaggcctacgtcatcgagcggctgggcgccttccactccgtctggggcgtgggcatccacttcaaggttccgttcctggagcgggtggcaaaggtggtttccctcaaggagcaggtggtggacttcccgccccagcccgtcatcaccaaggacaacgtcaccatgcagatcgacacggttctctacttccagatcaccgaccctaagctctacgcctacggggtggagcggcccatgtccgccattgagaacctgagcgtcaccaccatgcgcaacatcatcggcgacatggatctggagcagaccctcaccagccgcgacaccatcaactcccagatgcgcgccctgctggacgaggccaccgacccctggggcatcaaggtcaaccgggtagaggtcaagaacattcagccccctccggacatacagagcgccatggagaagcagatgaaggccgagcgggagaagcgcgaggcggtgctccgggccgagggccagcgccagagccagatcctggtggccgagggcgagaaggagtccatgattctccgggccgacgccgccaagcaggccgccatcaagaaggccgagggcgaggccgaggccatcctcaaggtccagcaggccaccgccgaggccatcaagctgctcaacgaggccgatcccagggaggcggtgctgcgcatcaaggccctggaggctttccaggccgccgccgacggcaaggccaccaagatcatcattccctccgagatccagggcctggcgggcctgtgcgcctccgccaaggccgtgtttgactcggtggagcccaacaagcccaagccctccgctgaaagcaaataaagcagcgaataaagcggaggccgcccaagtgatatgtaccccctttactggacacccagtagagggggtattattatgcggtacacatatgagtacaaaaggaaatgtgtagaactgtatcgagaaggaaaatggccagaaacgccggaaggtgttagcgataaatcctttcgggataaagtgagactatgggtaagagcagaggatagccgcggtccagaagcactgaaacacaaaaatttcaacaggaactggacaccagaagaacggctggaactagtatcccaagtaatgtccggaaaatcctgtgtgtcagtggcaatcgaggccggtattcaagatagactattgtatcaatgggttcaaaactataaaacaaaggggtataatggcctggtagaaatgaaaaaaggtcgtccaagtaaaggggtaccccaaatgaaaaaggaagaagcaaggccactgaatgaatccgaacgagaagaattgatccggcttcgggcagaaaacgagtatataaaggcggagaatgaagttataaaaaaagagatcgccttgagagaagagaggcacgcagcgcaactcaaggcgagaaagcagcgatcatcaaagagctgcgtgaaaaaggataccaattgaaatatctgttgaaatctatgcagatggcacggtctacctattattttgagttgagcaaggccgatcaagttgctgttcgaaaccattgcttggcagatgaaatcaaagacattttctcacagcataaaggccgctacggtgtgcgaagagtatatcaggaactgataaagcgcggccacaaggtcaatcataagcgggtacaacggcttatgcacactatggggttggcaggaaagcgcccaaaggaaaagtatcattcctacaagggcgaggtcggcaaggttgctgagaatatccttgaccgggatttcagcacgacagctcctatgcaaaaatggactaccgatgtatctcagttcggtttttcgtgggggaagtgttatctctctcctatactcgacatgaacacaaacgaaatcatttcttatgatttatctcaaagtgccaatatggaacagatccagagaatgttggccggcgcctttacgaagtttccctctgtagatggcctgatctttcactctgatcaagggtggcagtaccagcacgtgtacttcaggcaggcacttaaagatcacaaaatcattcaatccatgtcaaggaagggcaactgttacgacaattgcatcatggagaccttctttggacggatgaaaaacgagatgttctacgggcatgaaaaagagtattcctcttttgaaacatttgccaaggctgttgacggctacataaattactacaacaacgaaagaatccaagagaaaacaaaatggatgcctcctacaaaattcagagaggcatccatgtgcacctaattcaattttttatgtgtccagaattctgggtacatatcactcgggcggcctccgctttgcttatctgcaccaggtgataccggcatccgtccgctccggggcggcggggtgctccggagcggcgtagcccagggccacccctaccaggggctcgtagccctcgggcagctccagccgggcccgcagcgccgggtcggagaaggcggccatgggccccatcagaaagcaggagcccagtcccagcccagcggcggccagcagcatgttctccgccgcgcaggatacattggccatgttgaagcccttctcatccaggccgccgggggcggagagcaccaccagggccgccgcgccgtagagagggtgatagccctcctgggcggccaggttctccaggaagggcacgccggagcgggccatgcccgccaccgccgccgcgtccaccgcttggagctgctccggccccgcaaagacgctcatgtggagccggccgaagatgggtgcctggttgcccgcccggagcacggcctccagcttctcccgctccaccggccggtccccgtaggcacggatgctccgccggatctcaatcgcctgctgtatttccattttaaaatacccctttccttttctggtccttgttggtatcattatagacagcggcgaaaaaagtacaagtacgcaatttttctttagccggtaagaaaatacttagtggggaggcaacaccatggagggctgtccggtcaaatttgccctggggctggtaagcggcaagtggaagctgcgcatcctgtgggagctcaaccagcaggaggtaatccgctttaacgaactccaacggcggctggagggcatctccagcgtcatgctctccaagtccctggaggagttggagagagccaggctggtccaccgggagcagtatcccgaaattccgccccgggtagagtactctctgacggcgctggggcggtccattgacccctatctgcgcgccctgggcgagtggggcatgcaggcctatgaggcaatccaggccggctgaataaggcccccggaaccgattggttccgggggccttgccatttcccgcttacatccagtgctcctcgccgtcatagacacggtagctgtgggcgttggtggcctccacaatgtcgtggtaggcccagtaggaggcgctcacatcggggaactggcgcagctcgccggcgtggtcgtccacgtagtcctcgtccgccgcccggtccagcaggcggttggtaatggccgtcacctccgcccgggtgatggtggcctccggacggaaggtgccgtcggtgtagccggtgatccacccgtactgcaccgcccccaccacctggtcgtagaaccagtcggaggaggtcacatcggagaagggattctccccgccctcgggcaggcgggcaaagcgcatggccatcaccgtgaactccgcccgggtgatggtgcgctccggggcgaatttcccgccgcctacgccttccaccatgcccagggaggccagggtctccaccgcgcgggcgtaccaggcgtcggcgggcacgtcggtgaagcggaccgtactggagacgtcctgatccagcaggagattatagaacatctgcgcggcctcggcgcgggtcatgtggtcgtcggggccgaagaggccggttccgtagccattgaggtaggccatatggtcggtggtgttgagccagcggtccacgcccgtatccggggccttctccacggcgcggaactccgcctcaatggtgtggttcttacgcacggtttcaaaggtgtaacggctgaccgcgcccacactttcgccgtccaccagcacgtcggcaatctcatacccggcatcgggggtgatgcggaaggtcttgtcgctgccgcggctcacccgcaccctgccgtccgggctgatcccgccgccatggcccgcgctggcctcaatggtgtaccgggtcgtgccggtgctgccgccggagccggaatcctttgcatactgcgccgtaaaggtcatgtccccggtgaccgtcagatccagcacttcattactggtgcgggttataccatccgttcccagccagccggtaaagctgtatccgctgtccgcagcaacgctcggtacaggataaccgctcttacgcatcgtggacccgtcttttactgcaaagttggaagtcccctccagcgtaccatgctcaccagtctggaagagaactgcatggcgctctacctgagttacctccacttggagtgtatagctcctgctcacggttgcctccgtgtcggagtccgaaccgaaatcaataaaattgtgatgggacttgtagaaaagctccggggtacctccgttttccaccaggtaaccatagatttcgaccatgtagtagtgtccatcggtcctggcgtgctcctggccgtcgataggaatgaccgcattttccgtcttgacacgatttagaattccgttttcagcggagctggaaaacaattcaggttccgccctgcttctggggccgttgacaccgctttcctctccggattcatcccaccagcagtattggaaatacacataggtatcctctgtgccctgctgctctttcagcagtgggtgtgaaacctgtacccctacggtatgcgggcccgccgcatccaaatctatgcttaatgtgtggaaatccgcttgaacagtaccgtccgcaacaggttgaattgtcgggttctgtatgacatagtctatttctaccgttggattatctgaagtaatatttatttttccgctgtctgtcaattttttgtcgtccactgtccaaaatgtattataaccgggcttggacacctgttctcctgcgggctgcggaagcagatagtcctggttgacggcccaaaatcctgctgcctcatcatactcatactgaatggactgatagtttagtttatcctgcttgatgacaccctctttggcattctgaaaggtgagcgtcaccggataggacaatgcacgttttaccgcccctgtaaagctccggcccactgtatagtccacatagcttttcctatttaaaaacaccaccaacaggtcatcgtttccggttttaaatgctgatgtatcatatccggttaatcgtggatcccatccgtctccttccttttgaatgatgatctgggaaatccgtttgctgtaaaacgcctcacttccgattgtctctacactagcaggaataattacctttgcatccacatcggaagcaaaacagttcttaaatgtctgccttccaatataggtaaggccctccggcagttcaaaaaccgcattctggttactactaccggccacgcggatataccgaagtccttcgcacccgttaaatacagaaccggcagaggatgatctgcttcctaattctttcaacgtttttggtagaacaactcctgtcagattggagcagccggaaaaggcgctttttttaattactgagacatttgtcgctgataaatcaagtatccctgtcagttggctgttcccctgcaaagcctgctcaccaattgtttcaagtccagttgcatcatcaaaactaagagctgcaacactgaaactccccaacccatccatatatgtgactgcatcatgtaattttttatcgcttgtataagaatccttgagcccatcgttattaatttccgtcacgcctgaggggatagagatagccaaatagatctttcccttatcaggattaacgtttgcaaaccatgttttatcgattccatataaggttccgcccgaaatagcaagcccttcttccggcactgcgattggcgcccctgccgtgcttccatctaccactgattctcctgactcaacagaaattgcagttatcggaatataagaaataatcataattaagcatatcaatatctttagtaacctgcttctcataaataaatctgcctcccatcttctgatttggaattgtgtaccttttcaaagcagcagattgtaaggattacctttccataaagtgattgatattgctccttttctatgctatacttcaatttatagaacaaaggcagggtgtttgaaaaggtacactttttcaaattgatgtccgttcttcggcagcgttttggagagatccctgccttctctgcgcaaaaaagaggtgcagcgctccttcgggagcgctgcacctcttttgacctcattttcattttcgccgggcaggaggcgggaccaggggctcgtcgtgctcgatggtgtcatcgaagtagtcgcggtcctggagccccggccggtggtggcggatggcctcgctgatgatgggatagagaacgatggccagcaggccgccggagaagccgttgttatacaggttaatgccctccaccggggttccggcgtggagcaccacggaggagtggaggaaccccgccacgatgccgaagggccagccgaaatagcccgagataggggccagagtggttccgaacaggagggcgagctgcacggaactctggttgatatcgaagtgcataaaaacgccgccgatgaccacgcccagcatgatgggggtgatgttgcgggcgtgcttaccgaaggcggagaagcccatgatggtgagaatgccgcccagggttgggccgttgagatcgccgccggtggcgaggatgaaggccatgccgatgagcccgttgacccccatgttgatgagcaccggggcaggcccaaacatgcgaaggtaatcgctgggagcccggccggtggtgcgcagcaggcggcggtaccccgcccaggcggcccacgccgggcggccgctgaaaaaaaagcctgccacagtcagccctaggcagggcaccccaaggaagatagcaaagtgcaggttatagccctccgcccagtggtgggccacggtgggattggcccccatggagctcataacgggtaccaggatcatggccagcaggccgcaggcgaaacccatgttgtagaggttcatgccgttctggattttgtatgtataggcggagaggggcggcagcacaaagccgatgagcagtcccacggcgataccccaccacaggttgccgaagccgttgtccagcgccacataactcaccaccggggccagggctgtggccagcagggacacggagacatacttgccgaacggctcccgccgcgccttggcgtacaggaaggtaccggcgatgatgggccagatgttgacaatgttcttgccgaacagggaaaagccagccatcaggcccagctccaccagtgtgaagccgttgggcggctccttgctcaggtagagcagcagcaggctcaccagcgtcaccagggcggagttgaccagggccgcgcttacacccgcaattttcacgtagtcggtgatcagcgcgtcctccgtaacgatgatcttccacagtcctggcagcacagtggacggatcgcccagcaccagtccgatggcagccaggaagacgcaaaagcagatgacggcggggtagagctttttataacgcatggggctccctctctttcctcatcctcagtctcaggggctcagggctgcgtggaaaaataggcccgggtctgctccgcgttgcgcatgacctcgtcctttaatgcctccaggctggggaacttccgctccccccgcagacgcttgtagaactccattcggaccgtctggccgtagagatctccctgaaaatccaggatgaacccctctacagtcacccggtctccgtcgtctaccgtgggccgcactccgatattggtcaccgccgggcggctctcgccgttttcaaaggtcacccgcgttgcgtacaccccgtgagcgggcaccagcacccccggctgaaaacgcaggttcaccgtggggaaccccaaagtcccccccagcttcttgccgtgggccaccgtgtcggtcagggtgtgggggtggcccaggaactggttggcccgctccatctccccctgggccaccagggtacggatataggtggaggagatggtgatatggtcctgtaccaccttggggataatgtcgcagccgatgcccagctccccgcagagggcctggagccgctccgggttgccctcccccttgtagccgaagtggaaatcatggcctgccaccaggtgcaccgccccatgctcccccgccagataatcggtgacgaattcccgccagggcatgtgcatcatccgctcgtcaaagtgggccacaatgacctctcggataccgtagaaccgccgcattagctccgcccggtccaggggagagctgagcagggggaccgcaggggtttttaaaatcaggttctccgggtgggtgtcaaaggtgaccgccgcaggaacggcccccagctctgcggccttctcccccacccggcgcagcagggccccatggcccagatggacgccgtcaaaaaagcccaaggcgatcacacgtttctctgtctgcataccgctacacctcgaaaaagctcttgatagtgctcatcatccccccggcgcaccggcccagcaacaggaattccccgccggggccgtacacccgccagtcgccgtcggccgcggagcagggaaacgggttgccgttcttcgccttgcgcagggccgtcccctccaccgtcatcgccggataacggaagaaataggcgtccaccggccggagcagggccgccggatcaggtgcgtccagcaacgcctccagcggcaccgcttctgccagggaaaacccggcggcctcggtgcggcgcagggcggacatgcacccgccgcagcccagggcggccccgatgtcgtggcatagggtgcgcacataggtccccttggagcagcgcacccgcagggtatagcagttcggcccggtctgctccaccacctccagggcgtggatggtgacgggccggggggcccgctccacctccttccccgcccgggccagctcatagagcttcttgccgtcccgcttgagggcggagtacatgggcggaatctgggtgatctccccccggaaggcggccagcgccccctccagggccgcccgatccgcctccacggggcgctcctccaccacctggccggtggtatcctgagtattggtgactacgccgagttttaacccagcgatgtattccttttcggattcggatgcaaactccaccgcccgcgtcgcccgccccacaaatacaggcagcacgccggtggccatggggtccagcgtcccggcgtgtcccacccgcctctcatggaggacgcccctgattttggcgcacacgtccatactggtccactcctggggcttatcaattacgatgattccatttgccataaaggtggcctcccgtgcgccaaaaatcggcgtcttttctggtttgtagggcgggcagcaggccgacacgcaggtcggcccctacaggcaggccgcggcctctatgccactgcctccacctgccggatggcgtccaggatggccgcctccgcctcggccagggtgccggagacggtgcagcccgcggcggccgcgtggccgccgccccccagccgggcgcacaccttggtggcgttgagcccgccgctggtgcggacggacagcttgcagcccccctccgccagctcccggatggtgacggaggtctccaccccctcaatctgtcccaggaaggcggcgatatcctccatatcctcctcagttgcgtccgcctcgtccatgagggacagggacacgggggccacagcgattttcccgtcctcatagcggtgcatccgctcggtgagcagccgctccacctgaagccgcgcccagctcttggtgcggaagtggcgcttattgagagagaacacgtccatgccggtttccatcagggcggcggctacccggtgggtgtccgccgtggtgttgctgtactgaaagcagccggtatcggtggacacggctacatagaggggcaccgccatggcgggggtgatggggccgagttcccggaggatgtcgtagatcagctcgccgcaggcggcccgcccagcgtccaggcaggtctgcgccgcaaagaactcctgggaggggtggtggtcaatggccagatcaaccccccgcgccagccagggttctccagcccgggtgaacaggctgcgggcggcgatgtccacgctcaccaccgtctccggaacatagccctccggggccaggcggccctccagatagggggtgaacaggtgggtctcctccgtgtggggacagatccacgccgtcctgcccagggcccgcagcccctcgcacagggcggcggcgcagccaatggtgtccccgtcggggcgcttgtgggtgaggatcagatagttgtcatgctgccgcagaaaggcggcggtctccttcacggtcatggcgctcactcctcgccgtccagctcgatgtgggcattggccgggttggcgggcttgaccacctccgggttgcggagcatgctcaagatgtgggcgccggtgtcgatggagtcgtcctccacaaactgcagctccggggtataacgcagcgaaagggcccggcccagctcccgccgcaggtagcccccggcggacttcaggcccttgacgatctccttcacgtcgctcttgtccagcacgctgacgtagattttcgcgtagcggagatccggggtggtgtccaccgccgtgatggacaccaggccgtgcactcgggggtccttcacggtgcggatgagggcggccagctcccgctggatctcctcgttgatgcgtccgatgcgattgctcggcataatatactcctttccagagggctgcgcccccggtcaaatacgaatggtcaggcaggtctggaagttctcctccagttgcttcagggtgtccagctccacatcccccagggcgccggaaaagcgcctcggtcgcgcggggtcgttccccacccacaggttccacagttccacggtctctccggggcgcagatgctttgccagataggccctcagctccgccgcgtcctcctgggtggcccgcagatccagctggtaccggcagggcttcatggtcaggtacagatcctccaccgcttcccggtagtatgtgtgctcccccacggaaaatccgctcgcctcaatacggaccgtgtacccaccataggagctggtctcgacccggcggacaccggactcgtacaggggcagggggcggtcggcacacagcagggtgacggcgctcataaaaatcctcccgataaagacgcacagacccgccccctcctcaaatgacttggggacggaacgggtctgatttggttttttaccggcttggggcgcggcgggccgatgtgggcatcggcccctgcgaatttctcgggtgaggccagacatgcggcacgatagcccggcagcataccgcacgccccatctggccactccatatcgtaggggcggcctttatggccgcccgcgggcgaccacaagggtcgcccctacggcgttttacgaagccgaaagaaatttatacctcgatctgctccacctcgtcgccgcaagcttcagatccctcgctttgccgcttacggcaaagctcgctccttccgctacgtctcctctccgggccaaacccgcttcgctgggctccggcccggttcaggctgcgggaacagctttacaccccgatctgctccaccgcagcgtgaagaaaatttgcctgcggcaaatttttagcgtaggccgcagcggctttgccgcgaggaggggactccgcaggaggcagggttacacctcgatctgctccatcagataggcctcgatcacgtcgccctccttgatgtcctggaacttctcgaaggtgatgccgcactcgtagccctgggcgacctccttcacgctgtccttgaagcgctggagggaggcgatggcgccgtcgtagatgacgatgttgtcccgcagcaggcgcatctgggcaccgcgctgcatcttgccgtttgtgacatagcagccggccaccatgcccacaccggtgatgcggaacacgttgcgcacctcggcctggcccagctccacttccttgaacttgggagccagcatgcccttcatggcggtctcaatctcattgatgcagtcgtagatgacgcggtacatgcgcatatccacgttgttgcgggcggcggactccttggcgttgttgtcggggcggacgttgaagcccacgatgatggcgttggaggtggtggccagcatgacgtcgctctcgctgatggcgcccacggcgcagtggatgaccctcacccggacttcctcgttggacagcttctccaggctggccttgacggcctcggcggagccctggacgtcggccttgacgatgatgttcagatccttcatctcgccctgcttgatctggctgaacaggtcctccaggctcaccttgcccacgggggcggaggcggccatcttctgctcatgcttgcgctgctccaccagctcgcgggccatgcgctcgtcggccacggcgtggaagtcgtcgcccgcgccgggcacctcgcccatgccgatgatctccacgggcacggaggggcccgcctcggtgagcttctcgcccttggcgctggtcatggcgcggacgcggcccacggcggtgccggcgatgatcacgtcgccctgcttcagggtgccgttctgcaccagcagggtggccacggggccgcggcccttgtccagccgggcctcgatgaccgcgccgtgggcggagcggttggggttggccttgagctcctgcatctcggcggtcaggttgaccatctccagcagattgtcgatgccctcgccggtcttggcggagatggggcagatgatggtctcgccgccccactcctcgggcaccagctcatacttggtgagctgctccttgatgcgctcggggttggcctccggcttatccatcttgttgatggccacgatgatggggatgttggccgccttggcgtggttgatggactcaaccgtctggggcatgatgccgtcgtcggcggccaccaccaggatggccacgtcggtgatcatggcgccgcgggcgcgcatggcggtgaaggcctcgtggccgggggtgtccaggaaggtgatggtcttgccctgcacgttcacctgataggcgccgatgtgctgggtgatgccgccggcctcgccggcggccacgtgggcgttgcggatatagtccagcagggaggtcttgccgtggtcgacgtggcccatgaccaccaccacgggggcgcggggctccagatcctcctccttgtcctcggcggtgtcgatgagccgctcctcgatggtgacaatgacctccttttccaccttgcagcccagctcctcggcaatgatggcggcggtgtcgaagtcgatgacgtcgctgagggaggccatgacgccgttcttcatcagggtcttgaccacctcggcgccggtcttcttcatgcgggaggccagctcgcccacgccgatggcgtctgggatcttgacagtcagcggagtctttttggcgatctccagctggagccggcgcatcttctcctgctcctcctggcggcgcttgctgccctggaagccgcccttgcgctggttgcggccctggaacttctgcttgccggcctgcatctgcttggtcttgcccgcagccaggttctccagccgctcgtcgtacttctccaggttcacctggccgcccttgcgggtgtccactaccttcttctcggggacgcgggtagcgggccggttcgccggctgctgggccggctgcggcttgccctggggctgctggggcgcgggcctgcccgccggcgcggcgggcttctgcgcctggggcgcggccttggcgggctcccccttgggggccggggcagccttgggctcccggtagacctcggcgtagatgctctcgatgttgtccacctggttgtgctgggtcaggtactcgaagatcagggagagctcccggtcctccagcacctgcatatggttcttgggagccgtcgcatattttgtcagaatgtcggtgatctccttggagttcttcttgaaatccttggccacctcatgcacgcgatacttgttgttcagcaaataagccacctccatcggcgggcttgcgccaataggaaaacgcggcggggccgctgcgctttcttattggaacaagccctcgttgttccaatcctattgtgtgccatggtctcatggcgtcttcttcttgacggtcagcctgccccggggcagcgtccgcttcccggcgggctccggcggggactccttccgggcgggcggggccgcccacggcttccttccgcccttttgcagctttttctcgtggcggcgctgttccttctggcgctggagggccttgtccgccttctcactcagctccgccgacgccgcgccgtaggtctccggcgctccggcggccagcctggccagcagggcggccgccagccccacatcggtgagggccagcatggcgcaggatgcgcggcccactgtgccgcccagctcccccttggtgtagggcacccggaaccagggcgccttgcccgcctgggcaaagtgggcggcccggcgggcgctgttgtccgccgcatcggaggccaccagaatcagcctggcctgccgcgcccgggcggaagcaccaaccggctcctcccccacctccacgcggcccgccttgcgggcaatgcccagcagatgcagcacgttatccatcgccgccctccctcatctgcgcctccagcgcgtcgtagaccccgtcgggcatggcggcggagaacgcccgctccagcgccctggacttccgcgcccgcctgagacactccgcatcggggcagacataggccccgcggcccggcttcttccccttgaaatccagggatacctctccctccgggctcttgaccacccgaatgagctccttcttgggcttcatctcccggcagcccacgcactggcgcaggggtattttcttgggcatttttctcgcctcctcgcgggccgatgtgggcatcggcccctacgtgtgcggacatctcgcaaaaggcggagcctttttgcgggaaccctgtttccatcccgtttggggcaactgaattgccccaagctaaggttttgcctttggcaaaacgcttgtgcggcgcaagcgccgtcccgcctgcggcgggtcccagggagggccagctccactcaggaggccgcccccgcagggcttattcctcggtctcggcctcgtcgtccagcaggacgtccgcttcgtcctccggctcctcgtcagcgggggcggacgcgggcttgatgtcgatcttccagcccgtcagcttggccgccagccgggcgttctggcccgccccgcaaaaggcagggcctttttgcggggaccctgtttccatcccgtttggggcaactgaattgccccaaaccaaggttttgccctcggcaaaacgcttgtgcggcgcaggcgccgtcccgcctgcggcgggtcccagggagggccagccccactcaggaggccgcccccgcagggcttattcctcggtctcggcctcgtcgtccagcaggacgtcctcttcgtcctccggctcctcatcggcgggggcggacgcgggcttgatatcgatcttccagcccgtcagcttggccgccagccgggcgttctggccctccttgccgatggccagggagagctggtcgtcgggcaccaccacacggcaggccttgccctcttcccggacagccacactgacaacatcggcgggggacagggccgcggcaatgtactccgccggctcctcggaccatttgatgatatccaccttctcgcccttgagctcctccacgatgttgttgacccgctggccccgggggcccacgcaggcgccgatggggtccacgtcgggatcggcggaccagacggccagcttggtgcggctgcccgcctcacgggcgatggacttgacctccacggtgccgtcgtagatctcgggcacctccagctcgaacaggcgcttgaccaggccggggtgggtgcgggagatgagcacctggggtcccttggtggagcggcgcacctccactacgtagacgcgcaggcgcatcccttcgaggtacgcctcgcccttgacctgctcgccgggggccaggaaggcctcggtggcctcgctgcccgagccgatgcgcaggctcaccgcgccggagcggggatcgacgcgggtgaccacgccggtgaggatctcgtgctccttggaggagaactcgtcgtagatcatcccccgctcggcctcccgcataccctggatgatcacctggcgggcggtctgggcggcgatgcggccgaagtcgcgggtgcgcacctcgatgcggatgacgtcgccaagctgggcgtggggcagcttctcccgtgccatctggaggctcatctcggtacaggggttgtcgacctcctccaccacatccttcttgacgaacatgcgcacggtgccggcctcctcgtcggcctccacggtcacgttgtcccccgcgccctcgtggtcccgcttgtaggcggacaccagggcctgggtgattttctccagcatgtaggccttggggatacccttctccttctcaatcaggttgatggcggcaaagaactccgccccgtccagctcgttggacttctgcgctttggcattcttcttcggcataactgcactccttatttctcctgcgggcggccgcaggtcgcccctgcatcgtcggtacgggcccccggcctgtacccgctctccttaaaaatgcaccgtcaggcgcacctgcgccacatcctttttgacaaaggtgcgggcctcgcccgcggtctcgatggtcacatcgccgccatcatagcccttcagcacgccggtgtactcctttcggccgtccaggggccggtagaggcgcacatccacctccgcgcccaggaactgctggaagtgggcgggctttttcagggggcggtctgcgccggcggaggacacctccagcacatagcttccctcaatggggtcggcctcgtccagcgcgtcggacaggggacggctcaccgcctcgcagtcgttgatggagatcccctccggcttgtcgatatacacccgcaggaaccactgccccgcctcccggacatactccacatcccagagggtgcagccgttctgctcggcaatgggggcggccagagcggccaccagctccgtcactttcgccatggtttgacctccgtttcggggtatttcccataattttacataccccgttttttcaataagaaagagcggagccgcgaccccactctcaccataccactacttactatcgtatgtactatagcacaaaaaatcccgcagtgcaagaggttttgcgcgtttgtttggcccggagcccaatctgtaactcttttttcgttgacataaatcaaagctctgctagaatggagggtaagacagatgataaggagggcgtttccatggaggggagcaagctggccgccgccattctgggcgaggtgcgccgcgccgtggtgggcaaggacgaggtactggcaaaggtgctgctggccattctggccgggggccacatcctgctggaggacattcccggcgtgggcaagaccaccatggccctggccttctccaaggccctgagcctccggtacaaccgggtccagttcacccccgacgtgatgccgtcggacatcacgggcttcaccctctacaacaaggaggcgggccggatggagtaccagcccggcgcggtgctgtgcaacctctttttggccgacgagctcaaccgggccaccagccgcacccagtccgccctgctggaggccatggaggaggggcaggtgacggtggacggggtgtcccacccggtgccccagcccttcctggtcatcgccacccagaacccggcgggcgcctccggcacccagcttctgcccgactcccagatggaccggttcatggtgcgcctgtccatcggctaccccgcccccgccgacgagatggccatggtgcgccgccggcaggggggcgcactcctggagggggtgcgcccggtgctggagctcaacggcctgctcgccctgcgggcccaggccggacaggtctacgtatccgacgaggtgctggactacatcgtgcgcctggtgggcgccacccggagccaccccatgattctccagggggccagcccccgggccaccctggccctcaccgccatggccaaggccgccgccctggtgcggggccgggactatgttctgccggaggacgtatccctggtctttggcgacgtggtgccccaccggctgctcctctccccccgggcggaggccgaccgctccttcgaccccgcttcggagctgctggagcgggtgcccgccccccggatctcctgacgccatggcgtaccgtcggattgcctacgcggccctgctgggcggggcagtgctctttcagatcgtgttccgcttttacctgtccaccttcaccctggcgctggtgctgctgctccccctgctgtcggtgctgctgagcctgccgtcggtgctgggctgcacactgcttctcacctccgccgctcccacggtggtacagggggaggacgcggtctttcaggtgcggctgcgcagccgcacccgcctgcccctgccccggcttcaggcccgtctccactggagcaaccagctcaccggcgcgggcgggcgggtgcggtgggagcccgtgcgcaccgcaccgggcgctccgcccactctggagctggccaccccccactgcggccggctgatctgccgggcggagcgggcctggacctgcgatctgctgggcctgttccccctgcccatccccaccgggcggccggcggcggtgctgatcctgccgcccgatatggagcaggcgctgccggagcgcctgctggggggcggccccggcggcggtgcgctcctcccccgcccagggggagggccgggggaggactacgatctgcgggactaccggccgggggaccccctgcgctcggtccactggaagctctcctccaagcgggacgagctggtggtgcgggagaccctggagccccggcagaccaccctggtgctcacctatgaccacttcggcgcccccgcggcgctggaccagaccttcgcccggctgtgcgccctgtcccgggccctgctggagcggggcaggccccaccatatccagtgggccagccccaccggcggcggcgtggaggggcggctggtggactcggagcgggccctgctggcctgcctggagctggccttctcccggcccgccccggcggagggacgctccatcctggacaccgccctgcgcctgcccggccgcgccggtcccctccggcacatccatgtaacgcccaccggactggaaggaggtgcgccatgaagcgcaagcgccgcgccgccgcgcctctgcggcgggggcccgccgtcctgctgggggacggctgcctcctccttctggtgctggcaggcaccgtcttttccttccttaccgccttctccgtccagattcacgccctccccctgctgctgggctgcgccgccgccgcactggccttcctcggcctctggtccctcccccgccgctggtgggcccttcccctggccctgctggccgccgcctggctcctggcggtgcggcggctgtggcagccgctggccctgggtgccgacgccctgcgggtggacgtggtcaacaccgtttccgccagcctggagctgggcttcaccctggagcccgccctttccctccccgaagccctctggaccaactgcgccaccctgctcgtcctcctggccctggtaccgctgggcgccctgctggggctgggcgtcgtgcgcctgcgctccttctggctggtcttcgtcagctccttccccttcgtgctgctccccctgtgcatctcggtcaccccgggctggctgcccctgatggccctggtgctggggtgggtggtgccggccctcacctccctgctggcccgcacctcgcccctgggggccgcgcgcctcaacctggccgcccttccggccgccgccctgctgctggccgccctcagcctggccatgcccatggacacctaccagcgccccgcctgggccgaccgggccctacagcacctcaccaatcaggccgtccgcctgggggacggcctgctggaggggagcggccccttcggcattggcagcggcgggggacggctggccgacgccgacggctccgtctctctctccgacgcggggccgctgcgcttctccggacgcaccgtgctggaggtggagaccgacctcactggccgcatctacctgcgggggctctccgacgcggtatatgacggcgagagctggcagccgctggatgaggcggcctacaactggcaggcccgcctccgcggcgtcacatatggagcgcccgtcacgctggacatggaccttggcgtcactggggctgagtccctgttcgcccagttccagcccatgaatttccccgccctggcggttcgggatgcccacccggagagcccctacgccaggatcaccgtgcgcaatgtgggggccgatccgggctatgtctacgttccctaccatatcctgacccagcccggcgagctgtccggggcggaattcgtccacgacgcctatctggcccgggcggcccgggtgtggacccacaccatctacgtccagcccgacgcctcccctgccgcctccgcgggcctgcggggggagctgtctctggcggaggcggcctacgcggacttcgtgcgggagtactatctccaggtgcccctctactcggaaaacccggcgctccgccaggcgctggacggcgcgttggagccgctggccgactggctgcggcaggcccagtacgtctcccccgccgctgtgaagcagccctatgagctggaagccgcccaggtggtggcggactacctggccgccgtcgcggaatacgaccccgacacccccgccgcgccggagggggaggactttgtggcctggttcctcaccgagagccatcggggctactgcatgcactttgccagcgccgccgtgctgctgctgcggagcatgggcgtccccgcccgctatgtctccggctttgtggccgacgtgcccgcctccggccgcgtgaacgtgcccgactccgccgcccacgcctgggtggaggtctacatcgacggctacgggtgggagccggtggaggtcacccccgtctacgccgggagcactcccggccagagcggcgcggaggagcccgaggccaccccctcccccacgcccacgccccaggccagccgcgcccccgactccgccgcgcccacacccacccccacgccgtcggcggccctcccgaatgagggcccgaagctccctctccgcctgcttccggccctcctggccgcccttctgctggcgctggccctccccctgcggcgcttttgggcccgccgccgccgggagcggcgtttccaggatgaaaaccccaaccgggcggccatcgcggcctatctctatcttcagcggctgacccgctggggagcggagccgcccgcccgggccggggagctggcccaaaaggccaaattcagcccccacaccctcaccgccgaggagcgggacgcggtgctccgcgccgcccgcgccgcggcagaggcggtggacaagtccctcccctggtggaagcggttcgccttccgctatctgctggggctgtactgaggccccgttcggcctgaccgccgccgggcggcatttcccgcgccctgagcaggggcggcccctgtggccgcccctgcgttttcattcccacaccgcacgggccgatgcccacaccggcccgctgtgccaggcccggcgcctcttgcgcattacccgcccctgcattttatcttctcattcgacaggccgcccagtctctagtgagactgggcggcctgcatctacttttcatttcttgtttgtgcgggggataccgggggtcactccgtcagggcaaagaagccctcgggccggtccttcttgtcaaatacattgctgtagagcagcacccggtaatcctccacggcggcgtccagctcctccggcagcgcctcgttctcgccgtaccagttcccgccggcgtcccggatgcccacagtgttgatcaccggggcggcctcccacagccgggccaggtacttctgatacccggtcatgggcaggttggcggtgtccatcagcagggcggacaggtagttgagggacagctccaccccctgggcctccggtatgtcgtagttggcccagaggactaagggcaccatctgttttttctgggccagagcggtatccggggccgtccccagcacgtcggtatagaagttggtggccacctggggctggtggtcgccgaagaggaggatcagggtgggctcctccacctgggagaagtagtcgagcaggtattcgaaggcctgatcgctctggtacaccagggacaaatactggttgaccgtgttaaaccggccctccagcgccccggtaagccacacctcccggggcaggttcgtccacgccatctggtaggcggagtggttctgcatggtcacgttgaagagaaacagcggctcccccgcctccttctcctcataccagcggatcaggttctcgtagtcgcactggtcggtgacatagccggttttttcgtccccccgcatgtactcccggtcctggaagtccccttcaaagtatacctcgtcaaagccgaaatcccggtagaccgaggggcggctccagccggaggagcggtaggggtgggcggccacggtacggtaacccagggcggccatctgccccaccagggtgggatcgccgtcggagacatacatctggtagggcaccgtgcccgcgggcaggaaggcggtggtgttgccggtgaggaactcgtactccgagttggcggtcgtgccgccgaacacggaggagtaggcgtagcccttgatggtgttctccgtcagggagcggaggaagggcatggcgtccgtattgctctccacgccgggcagcacggaaaggtcggagagggactcgttcatgatgacaatgacgttcaccgggcgaatcatgccgtcctccccggccgccggcacggcggccgggtcgctgggagtgctcccggcgagggccgcgagggcctcctccgagtagctctccggccgctccaccctcatgtacttcaggcacaccgagaagttgaggaacaggccgttgccccgggtggtccacatggagggctcaatgccccggctctccacaaacccggtgccgaagaacacgcccaggaagaccgcggcggccccggccgccgggacaaagagccgccacgggaagggccttttcttctcgttcggcaggaaggacagggccagcaacaccgccgcgaacacgccgatggtgagccactgcatggagtcgggccggtagtcgtagttgcccgccacgttggcggcggtgcggagggtgaggaagtcgccgggaaagagggtgcgcccccggaaggagatcaggtagtggttggccatgcccaggccccaggcgatccccatggcccacttgacggccgaggcccgccgccggaggacgaagtagaaaaacagctcccccaggtagtaccacgccagattgagggcgatctgaagggaggtgaagtcagtccaggggttgttgtagttgaggtactccaccagggtgaaggagagcaggggggccaggagcattagggcccgggtggtccaggcggcctgcccttctcccagggggaggcgtggccatcggaagcgccgcctgctgcgcggggtgtctacggtgtatgtcatgtattgtttgctgccttctctcaaatgattatgacaactattttagcacagacgggcgaaagcgcaatgtgctttcgcccgtttgtcagaaatttatccccgtccggccacttgccgcgaggctgtcggagccgcccttctagcccggagccgccatgtgcagcggcggtccggcgagggggatcacccggtcgcagagggcgacgatctccgcctcgtggctggagaggagcaccggcacgcccagggcccgcacccgctccagaatgcgggccgcccgggcggcgtccacgccggtaaacggctcgtccagcaggtagagcccgccgccgcaggccagggcgcgggccagggccagccgccgccccatgccgccggagagggcagaggggcgggcgtgctcctccccctccagctcgaccagggccagccagcgccccgcctccccccgctgcgcccgggggagtacgtcggcgacgtgctgctccaccgtccgccagggcagcaggcggttctcttgaaacaggagggtggggcgggggggaaccgtcaccaccccggccgaccgccgctggaggcccgccagcacccgcagcagggtggtcttgccgcagccggaggggccggacagggcggtgatccccgtctccggcagcaccagggagaagtcgtccagcacccgcttttccccataacagaccgtaatatgttccgctgatatcacagcttcgccccctttcccagccgccggaacaggaggcccagggcgtactccagcagaaagctgagggcgatcaccaccgccgtccaggcgaagagatcgggggtctccagggtgatcttggcccggtagacctgggtgccgatggccagcctgggctggcagagcacctcggcagccacccccgccttccaggccaggcccaggccggtggcgcagccgctggcgaaatagggcagcaccgaggggacatacaccagccggagggtcttccagcggccgaagcggtaggcccgcgccgcctccaggagctgcccgtcagtctggctgatacctttacaaacattgccccacagcaccggcagcaccatcagccccgagacgatggcgggcacccgccccgtggaggcccacaggagcaccagcacgatgaaggaggccaccggcacggcgcggatcaccttcaccatgggccggaacagccagtccgcccaggagagggcggaggtaatgacggccaacagggtgcccgccgccgcccccagggcgaagccgccgaagatgcggcccaggctcaccgccgctgtccgccagaaggagggccgggcggccagggcggccagccgctcccacaccagcaggggagagggcaggagcagggccccatgtccgggggtatatactgtgtccacccaaatggccgcaagctgccaagcccccagccagaaggccaggggcacgacaacgcgcagtattttttgtgtggttcgattacggaatatagtagaaattatcatccgggatggcccctccgatcgaggtggggtcggcggcatagagcacctcatagtagtcggagatgcccttcagctcgtcgccggtcaggcagaccatgttggcctgggggatggccgccttggcgacggcggccttggggacgatgccgtactgctcgaccagggcggcagcctcctccgggtgctcattcacataggcgatggaggcggcgtactcggtgaggaaggcgtccaccgcctccgggtgctcctccacgaagtcgctccgggccaccacgcagcccatggtaaaggtgccggcggcccccacgtcctgccacacgtcgttgagatcgatggcgtcccgcacatcggcgttctgcatcatgacgctggtggcggcggggacggggagcatgcacaggtcgatcccgccggaggccatgagggccgtgacctcctcgctggtcttccactcaatggtcacgtcctcgccgggggtgaggccgctctcctccagcaggtagttgagcacgtactcggtgttggtgccctggttgatgctgtagatggtcttgcccgccagatcggccatggagtggaccgtatcgccgttctccaggatgtggagcacgcccagggtgttgagggccagcagcctgatgctgcccgccttgttgtagagggtggccgccagattggtggggaccgcggcgatgtccagctcgccgttgttcagcttgggcacaatgtcggtggacgggtcggagccgagggtcagctcatagtggaagaaggtcccctccgtggtgtcataggtaccctcctccgcctgggcgaaggccgcgtcgctgtcggcgagcagtttggccgctcccatgccggtggggccgttgagcaggcccagccggatggtctggtaaggggcaacggtctcggccggaggggtttccgcgacgggggaggacgtctccggcgcgggggactcctccggcccggccttgggggcgcaccccgcagccaggcccagcaccagggccaggctcaggcccagggacagcagcttctgtttcatgtcaatctcttcctttcctaattctgttccagcgcgtccggctgaagcacctgcacccgtctgccctcccgccggagaaccccccgcccggccagggcgtccagggcgcggtagagggaggcgcggctcacccccagccgccgggccaggccggcggcggagcagtccagctccacccatcccccctccagccgggagagcaggtattgggccaccttccgctcggcgctgccggcggtgagggcgtcgatcttgccgctgagaaagcagatgcggccggacaggtaggccacatagttgcgccccacctccggaaagcggcccatcagctcctccaccagcgcctggggcaggaggagcacccggcagggtgcgcgggcggtgagggtggtggcgtagtccgcccggtcgttgaacagggccgccgcgccgaagagatcccccggttccagcacactcatgatgagcgcgcccttgttcacctgcacccggccctccagcaccacgcccaggcagcggcggaaggcgtgaggggcgtaaatcaccccgcccttaccgttctcctgccggaccgtgcgggggtcggtccgggcgagctccaccgcctccggcggcgcaccccggaagagaaaggtctccgccaatcgggcccgctcggccgcttcccggctgtccattggctctccctccctcaaatctgtctcatacggtacagtttagtgtagcacgtattttccaaatgtcaagcgcaaatggggctgcttttccatagaatggggtaaaaaggaggtaactgccatgtcaaactgccgtcagcccggccgggatgcccgggcccaggccgagtcccaggcccaggccatcatcgcccagggccgccggatggcccgccagcggctggagggcgcccccctggaggaggagcccatgaagcgctacgcccatcccatcccctactgcatcgactgtcctaccccgccgcccgccgacgggctggaccggattctggaggccctggcctgccaaaatcagcttctggtggagctgctgggggccgtcaacgcgctcaccgccgcaaccctgagtatccagagccgcctctgagttcttacagattcgtgaagtttgcaaactttctcttgtcagacggcttcccattttatatactagtggttgcttgttgacataatcacacctgagaaaagggggcgcctctctgtggcccaacgccgtcgcatccgcaaaaaaaagcgtgtctcccccctccgccgggcggggaagctggcatatcgcatcctggtggtcctgtccgccatcatcgtggtactctactgcgcctatcgcctggcctccaaaaagcccacccaggccccggagcccacaccggaggcccccgccggctccctctccccggatcagaccgaagcgcccggccgccagaggcgggaagggacatacacttttctgctggccgccagcgaccagtccagcggcaacgccgacaccatcattgtggcctcctacgacactgaggctcagaaggtgggtatggtctccgtcccccgggacaccctgctggagagcgggaagatcaacgccgcctaccacaaggggccggagaacctgcgggataccgtctccgacctgctgggcgtgcccatcgactactatgtggcggtggacgtggacggctttgtggccctggtggatgagctgggcggcatcgagttcgacgtaccggtgcgcatgagctttgacgatcccacccaggacctccacatccactaccagcccggcctccagcacctgaccggcgaggacgtgctcaaggtggcccgctgccgcaacaactccgacggccccggctcctaccccgacaacctgtacggcgcctatccggacggagacatcggccgcacccgcacccagcagcagctcatcgccgccatcctgaaaaaagccctgtccaatccgcagaagatcaactcttacgtgaacctcttcctggagtatgtggacactgatctggagttcagcgaggccctctggtttgcccagcccgccctgggcctggacttctccacgggctttgccagcgccaccctggcgggtgagaatgtctactatgtggacagccggggctaccgctggggctcctgctacgagctggacccggaggccgccctggagaccgtcaactccctcatcaacccctacaacgcgccgctcaccgcggcggatctcaacatttttcagaagccgtgacaaaaaggcgccgctgcaatgcagcggcgcctttttgtcatgccagcagatcgggcccgggcagatccatctcccgcttgcgggcggcggagtgggccagcttctccgccagggccgcccggtttccggaggccagcgcgtcccggtaggactggaggttgtccagcagccggtccaccgccgccagcagggcgggctggttgagggagaagagctgtgtccacaaccccacgtccagggccgccacccgggtacagccccggaaggaggagccctcgaagcccctgcactgaaagagctccggatcgtcgcacaccgacacggcgataaggtgcatcatctggctggtgtaggcgatcagggcgtcgtgggcctgggcggtggtgcggcatacgtccttgcagccgatataggccgccagccgctccagcagggcaatgtgctccggcctgctgtcatcccggggcaccagcaggaagtgggagtcccggaacatctccgcaaaggcgtgctccacgccggagaactcggtgcccgccatggggtggcagccgataaaatccacggtaccgggcagcacctgggccgcctccaaaatggcggtcttgacgccgcacacgtcccacaccagggcccccggcttgaacgcatcccgataccgggccaagaaatccacgatcccctgggggtggagggccagggccaccacgtcggcctgggggagctcggcggcggcgtcctcggtcacacggtcgcccacaccgtgctcggcggcgtagcgcagggtgggctgggacacgtccacgcccacaatctcgaaatcctcaaagccctttaaagccagggccagtgagccgccaattaaaccaaggcccacaatcagcatcgtttgtttcatcgcgcactcctcttctttactgagggccggtcacagctcccgccccacgcagggggccagggcggtcagcctgcccatgagggtgtcaaactgggccggggtgatggactggaccccgtcacagagggcgtggggcgggtcgttgtgcacctcgatgatgaggccgtccgccccggcggctaccgccgccagactcatgcgctccaccatccacgccttgccgcaggcgtgggaggggtccaccaccaccggcaggtgggagagctgcttcaccgccagcacggcggagaggtccagggtgttgcgggtataggtctcaaaggtgcggataccccgctcgcagaggatgacccggtggttgcccccggccatgatgtactcggcgctcatgagccactcctcaatggtggaggacaggccgcgcttgagcaggatgggcttggaggtcttgcccaactgcttgagcaggtcgaagttctgcatgttccgggctcccacctgaatcacgtccacgcacatctcgaacatctccacgttgtcggtggacatgatctcggtaacgataggcaggccggtggcctcctttgcctcctggagcaggcggatgccgtcgttgcccatgccctggaaggcatagggggaggtgcggggcttgaaggcgccgccccgcagggcggcggcgccgctggcctttaccgcctgggccacccccacaatctgcgcctcgctctccaccgagcagggcccggcgatcaccgccagccggttcccgcccacgctgaggccattggacagctcaatcaccgtgtcctccgggtggtacttccggttggccttcttatagggctccgtgacccgcatgacccgctccacgccgggcagcagggacagcttctcctggtcgatgtgctcggcgttgccctctgcgcccaggatggtggtctccgcccccttggacaccatgactttgacgccgccctcctccatggtgtgtacggcggcctccaactgctccggggtaaactcccgcttcataatgacaaccatattctgactcctttcacaaacaaagaacccgcagccgcccaaaggcggccgcgggttccatcggctccaactgcggagcgccggaagattcctgacaggccggttatgggcaggcaaacagaccgctggcaaaatagcagcggtaatagccgtatgcataaccgacgtacctgcgcatgaacctctcacgctcctcttgtagagcactttagcactttttggcgcgaaagtcaagtggaaatttcacttgaaatcctacctgttccatggtattatatttgtcagaaaaggtagggatgtgcatgaaaatttccacgaaaggccgttatgcgctccgcctcatgctggatgtggcccttcacagccatggcgcggcagttccgctgcgggatgtggcccagcggcaggagatttccgataaatatctggagcagattgtaactcagctctcccgggccgggctggttcgctcggtccggggcgcggggggcggctacctcctcacccgtgagccagaggagtacaccgtgggggagattctgcgggtgctggagggcaatctggcgccggtgagctgtgtggatcaggacgatacctgccgctgcaaccgggccgaccggtgcgtcaccgtagaggtgtggcgggacattcaggccgccgtctccagcgtggtggaccgcctgactctggccgacctcgtgcgccgctatcatgagaagtgccccggacataacgcgtagaacagcccaaaataaatcagagccgccgtactgatttccagtgcggcggctctgattgtctggattacgcccctgcgatgctggcagcaatatgagcatcgctatagcccatcagcttgccataccgggtagccaggtcgatctgggccttctctgtgtaggttcctgctgcaatcatgtctttctcctcctgcttcagctccagatactcctgaagcactgcgtcgtcggcatagaggatatagacccactgaccatccatctccacagtggaaaacagcttggtcagaagaagatccttgtcgatgtagtactttacaccgtatccctcgcactttttcgccacataggatgtaagaaggggttcgtcctcgggatcaaagggatcactgaacgccagctccttggctccggtcatgattacatcgcagaaggcgcccacggtgccgtcaaaattgccgagctgaaagctgtactcgtccacagggggctgagccgcagcctcagaggtgtccgccgtgctcatgcgggaggttgataccgtccggctgtccgggcaccaggtcaccgcatagccgatgccttcaaagaaggcacgaacagggacgtagtctgccccattcaccgtcttgacgggaagctccgccgactgctcaccgcaggtcacggtcacagtgccctctccccgctccagaaccgcgctgatgttgcccgccagatccgaggcggaggcataaatggtgccgggctgctcaatcagcgccccagacaggagggtaaccggcttcccctgccagagaatcgtaggctcgctggtgtccttggtatagaccacctcgccgccggagactgtcatcagggcctgaatatccttgatctcctcctcaggacaggtcatgtagtcccggtcgatcactacaaagtcggccagcttgccgggctccagagagcccttgagatcctcctcaaactgaccataggcggcccagatggtaaaggcgcgcagcgcctcctcacgggtgaccttctggttggcgtaccagccgccctccggctcaccggcgcgggtcatacgggtgacaccggcatacaggccgtggaaggggttgaccatctccaccggcgcgtcagagccgccgataatgatgccgcccttatccagaacggtgcgccaggcgtaggccgtctgaatacgctcggggcccaggcggtcctccgccatggacaggtccgaggtggcatgggtaaactgcatcgcggtgaggatgccgagctccagggcccggtcaatatcctccggggtaacgacctggaagtgctcaatgcgcaggcgggggtcctcccggggattttccttcagcaggcgctcgtaggtgttcagcacctggtggttggcaccgtcgccgatggcgtggtacgcgatctgatagccgttgttgtaggccaggctcatcacgttgtaaatctcctcgtccgtaaagcggtaggaaccacgattgcccggatcgtcggagtaatccttcagcagagcagagccgcgggagcccagagcaccgtcgcccagcaccttgacacccattatactcagatggttgtcgtacaggccgttgaccggccggtgctcccggatgtagccggcctcggcgctgtccgtgctgttgagcatgggcatggcgtaaatgcgcagcttcagctcaccgctctcatagagatcctcatagtgctggatgtagttgacctttgtgcctgcgtccgtggcagaggtaaagccataggagaacagctcctcctgagccatgagcacagcgtttttctgtgcctcagcactccaggtaggaattaccttgatgaccattgacgccgcgttgtcggtaaggcagcccagcagttccccgttgtccgttttgagaatctggccgccctgaggctctggggtatccttggtaatgcccgccatctccagcgccatgctgttaaaccagcccatatggttgtctgcccggagcagatagaccgggttgttgggcgccacggcgtccagttcctcctttgaagggaagccgggctcatcccacagggtatccagccagccggaaccctggatccactcgccgggctccgcctccttggcggcctggcgcaccatctccagaatatcctccttcgatttaaagtagcagtccagcttcaggtggttttcccccagattgctgacatgcatatgtccctcgatgagaccgggcagcacggttttgccgccgaggtcggtgatctcagttcccgcacccacataggcctccgcaccggcttggtcgcccacatacaggatgcggtcccccttcaccgccatagtggtggcagtggagaagtcttcatccacggtgtagatgttgccgttgatgtagaggctatccgccacctccgccgggcctgcggccatggccggcaccaagccggccagcagtgacaggcttaggcccgctgcgcacagggcgtgcgctgtccttcgtttcattcgctccatccctttccattttaccagatttgacaggccccacagcgtgcgggccgcacaacgtgatacagtatagaaaaccccgccgcaattttctgttaaccactttacaaaatcgtcattttcttcgaaaataaagaaaataaattgggtatccatgtgcaaaccgcacgaaccgcctcccaatctgtgcgggggctgcgcgcgcagaaaccgggagaagggtgaacaccattggaaaaagagcttcgctgggaaaagcagtggattccggagcacctctccgccgttggaaatgaaccgtgggacaccgtgtgggacagactgaccgacggctttcgcccggagaccgtcccggcgggcacggtgttctatcagcagggcgacccggcccgcgaggtgatttttctgcaaacagggcagatccgggtggagtgcatccacagcagcgggaaaaagcgggtgctctgcctgctctttgaagggattcccgtgggagaggacgagtgcctgttcggcggcccgcgggaataccgggccgtcgcagtcactgcgtgtcagattttccgcatcccggcggaggtgttcaaacggcgggccgaggcctctcccgccctggcactgaagctgttccagatctccgcccggaagagccaggtgcttggccgcatgctgatccgcgacagctttctaagcgtgcgggggcgtgtcattcagttcctgctctccgtgtcagagccatacggtacagaggagggggcgggggtccgcctcactatccggctgacccaccaggaggtggccgattttctgggcatctcccgggtggtggtgtcccagtgctttcaaagcctgagccgggagggcctgctgaaaaagacgcgccagcactatctgctccccgaccgtgccgccctggaggcccagctccatacataatatggctccggccacaggcaaaacgcctgcggccggagccatgctgccgattgtgtccaccgcgctctattcacgcaaacagccctgtagagaggtagcgctcgccagtatcggggagcaccaccgcgatggtcttgccccgcatgtccggccgctgggccaggatgcgggccgcgtgggccgccgcgccggaggacaccccggccaacaccccctcggtacgggccagctcccgggcggcggcataggcctcgtcgccggtgacggccaccacctcgtccaccacccccatgtccagggtgccggggacgaagcccgcgccgatgccctggatcttatggggccccggccggccgccggagaggacgggagactcggccggctccaccgccaccacgcggatggcggggttctgctccttcagatagcggcccgcgccagtgatggtgccgccggaacccactcccgccaccagcacgtccacgccgccgtcggtgtcccgccacagctcgggaccggtggtctcgtagtgggcccgggcgttggcggggttgttgaactggtcgggcatccacgcgcctggggtgctctccagcagctccttcgcccgctcaatggcgccgcccataccccgggccccttcggtgagcaccagctccgcccccagagcggccagcaggctgcgccgctcctgactcatggtctccggcatggtgagcaccacccggtagccccgctggcggccgatgtaggccagggccacgccggtgttgccgctggtgggctccacaatcaccgcgccgggctggagcaggcccctctcctcggcgtccaaaatcatgtaaaggcctgcccggtccttggcggaggacagggggttaaagctctccagcttggccagcacccctgccccgggggcaaaccgctccagccgaagcaggggggtgttcccgatcagctcgggcagtgtatttgcaatctgcataggtaatacctccctcataatttagattctattcagcagtataccaccaaattcctacaaaatcaataggattttagtcggatgagacggcccgcaaagcgggccgtctgtgtggacaggaccttagaacaccgcctgcacggcgccggcataggtctcgtcaatgaacgccttgacctcgtcgctgcacagggcctttgccagagcctggatggcggggtcgctctcccggccctccttgacggccagcacattgacataagcggtgccggcggtgccctcggcggactcaatcgccagggcgtcggccaccttcagatcggcctggatggcgtagttgccgttgatgacggcaatgtccaggctgcccagggagcgggggagctgggcagcctccatctccacgatctcatagttgtgggggttctccgcgatgtccagcttggtgggctccaggcccacatcctccttcaaagtgatgaggccctgctcctggaggagcagcagggcgcggccgccgttggtggggtcgttgggcacgccgatctgcgcgccgtcctggagctcctccaggctggcggtcttgccggcgtagatgccgaagggctcgtagtgcacatctgccacgctcaccaggtgggtgccattctcagcgttgaagttgttcagataggtgatgtgctggaagtagttggcgtcaatgctgccgttctccaccgcggtgttgggctggatgtagtcggtaaactccacgatctccaggttgattccctcctccgccagcagttccttcaccacggccaggatctcggcgtggggagcgggagaggcgcccaccttcagggtggtgccctccagggagccggtctgggtgggggcggcaggggtgtcagtgtttgcggcgggggtgtcggcggtaccgggggtgccgccgcagccggccagcaggccgagggccagggcgccggacaggagcagggatgcgagcttcttcatggtgcatttctccttttcattgttcctcaaagggaggtggtattcccaaatcagagcacaaaaaaacgcccttgaatccaaattcaaggacgagagccttccggcttcgtggtaccaccttgcttcacccctgcctcacgacaggggccttatggagtactggcatactcccgcgcgctgacgggcgctcccgtcgcggcctgtgcctgtggcagtcagccgcgccgctccgagaccatcttccccaaagccttccgtacccgtttccaccattccgggctctctgtgccgtatctctctggctactcttctcttcctcgcgtttgaggggcgttattcagttccgcttgggttgcacttagtttacaaccggaaggcgctcctgtcaatcgcatattctgcacaaaaaagagggggcggcaaagcaactgctttgccgccccctccaaaattcacatgccgccggggctgcgcttgtcccggttcatctgccggctgacgttccggcggagctttcttcgcccagcccggttggtgatgcggtggtccgtccgggtggccagggaggtacccagtgactggaaaatctgcaccaaaaccacaataaagaccacggcgatgagcatcaccgcatagttgtatttataatagccgtagttgatggcaatcttgcccaggccgccgccgccgatggcgccagccatggcgccgtagcccagaatggtgataaatgcggtggtgaagctggccaccagggagggcaggctctccggcaaaatcaccttccagatgatctggaagggggagcagcccatggactgggcggcctcgatgacccccttgtccacctcccgcagggaggtctccaccagccgggccacgaaggaggccgaggcgataatcaggggagggatggaggccacagtgccgatggtggtacccaccaggagctcactcaggggaagcaccatgatcatcaggatcaggaaaggcaccgagcgcaggatgttgatggcaaagttgagcaccttcatcaccgggccgggcagggggcgcacgccgtcctcctcccccgccaccaggataatgcccaggataatgcccaggacgcaggccaccagagtggccgccacggtggagtagatggtgtcccagataccagtctggaactccttccacagggcctcgttggcaaaggcctcgcgcatctgctgcataaatttatccatggtagtcgggcacctcctccacggtgacgtccttctgggccttcagatagttcatggcacggatagcctctccatgatcctcgggcaggcccagcagcatggagccgaaggccttgccgtttacgttgcgggtgtcggcccccagtatgttcaccttcacgccgcagtcgatggccagggaggcgatgaggggctcgtaggaggagccgccgttgaacaccacccgcaccacgcccgccacgggaaacttgtcgatgttggccccctccgggaacaccagccggcggcctgcctcggtctgagggttggagaacaccgcctccactgtgccggtctccaccatgcggccgcgctccaggatggccacgtgggagcagatctcctccaccaccgccatctcgtgggtaatgatcacggcggtgatgcccatgcgccggttgatgtcctggatcagcctgaggatgctgcgggtggtggtggggtccagggcggaggtggcctcgtcgcacagcagcaccttgggattggaggccagggcgcgggcgatggcgatgcgctgcttctggccgccggagagctgggccgggtaggcgttggccttgtcgggcaggcccacgatgtccagatactccagggcgcgcttgcgcgcctcccccttgggcaccccggcgatctccatggggaagcagatgttgcccaggcaggtgcgctgcatgagcaggttgaactgctggaagatcatgctgatggagcggcgcttctcccgcagctggggggcggacagctccatgagatcctgtccgtcgatgaccacctggcccgctgtagggcgctccagcaggttgatgcagcgcaccagggtggacttgcccgcgccgctcatgcccacgatgccgaagatgtccccgtcccggatggtcagattgatgtcgtccagggcttgaaacacgccgtcggccgtgggaaaggtcttggaaatgtgttttaactcgatcacggacccatactcccttatttctcacaaagttccgtcctattttatgacaagccccgccctctgtcaagaaaaaagccccggaaccgcttcgattccggggccttgcgtgtcctggctcagtggccgcaggagcagcagccgtgctcctcatcctcacagggcaggcggagggcttcgggcacctcccggccctggcggcggtagtagtcggccagggcggccttgatggcctcctccgccagaacggagcagtgcatcttgtaggcgggcaggccgtccagagcctccgccacggcggcgttggtcagggtcatggcctccgcgatggtctttcccttgatcatctcggtggccatggaggaggtggcgatggccgagccgcagccaaaggtcttgaacttcacgtcggtgatcacgtccccgtcgatcttcaggtacatcttcatgatgtcgccgcacttggggttgcccacctggcccaccccgtcggcgttcgcaatctcacccacgttgcgggggtgctcgaagtggtccatcaccttatcggaatacagcatagcagtttctcctttccagttacagctcccaggtgggcttctgtgcgtcccggtcccatacgggggacagctcccggagatacgccaccacctggggcacttccttcaaaatgtagtccacgtccgcctcggtattctccgcgcccagggagagccgcagggagccgtgggcaatggcgtggggcaggccgatggccagcagcacgtgggaggggtccagggacgcagaagaacaggccgagccggaggaggcgcagatgcccctggcgtccaggtggagcagcagggcctctccctccaccccttcaaagacaaaggaggcggtgccgggcaggcggttcaccgggtcgccggtgaggcgggtgtagggaagcccggtcaggccgtcgatgagcctgtcccgcagggcggccaggcggggggactcccggctcaggccgtccaccgcctcccgcagggcggcggccatacccaccgcgccggggacgttctcggtgccggagcggcggcccttctcctggccgccgccctggatgagcgcgggcaggcgcaggggctttttcacgtacagggcgcccactcccttggggccgcggaacttgtgggcggacagggagagcagatccacattccacgcttccacgtccacggggatatggcccacggcctgcaccgcgtcggtgtgaaagagcaccttgtgggcccgggcgatgcggcccagctcggcgacaggctctatggtgccgatctcgttgttggcggccatgatggagataagaatggtgtccggccggatcgccccctccagggcggcgggatccaccagcccccgcccgtccaccggcaggtaggtgacctcatagccctgcttctccagatactgggcggtgtggaggacggcgtggtgctcgatggcggaggtgatgatgtggccgcccttccgccccttcagggccatgagctcggccaccccccgcagggcccagttgtccgcctccgtaccgccggaggtgaagtagatctcctccggccgggcgttgaggcaggcggcgatctccgcccgcgcccgctccaggtcggtcttgccctcctgggcaaagcggtacaggctggaggggttgccgtaggccgtggtgaagtgggggagcatggcctggagggcggtatcggagacagccgtggtggccgcatggtcggcgtaaatgaagtgcgacatagagacgctcctttcaaaacttcttaattcctatatgtttactataattataggcctgccaggccactttgtcaaggaaatttttacggaggcggaacatttcattaaactttgcttaaatcgcccggattccgttgactggccccgcccgccaatgctatagtggaggcagattatatgaaattgggagatagcatggataaaaagctgttcaaaagcattctgctcctcatcacctatacggtggtactggtgatggtactcagccgcctgggcctgatcgccggcggggtggcatgggtgctggggctggttaagccgctgctcatcggcttcgcactggccttcgtcctcaaccggccctgccacttctttttccgcctctatgatcgagggctgtcccgcacccgggccaggggggcggcccgccccctggcggtggtcacctcctatctggtgctgattctggccatcgccgccatcttttcctttgtggtgcccaagctggtggagagcatccagaccttcgccctcaacctggggggctacctggccaacgtccagggctggtacaacgatatcatctcctacttccacctggatgtggaggcgctggacctgtctggcctgaacgatgtgctcaaaaacctgtttaactacgtgctgggcttcctgtccgacctgggcccccacctgctggagctcaccagcggcatcgtctccatggtggtcaccggggtgctctccctggtcttctccatctatatgctctccggcagggacaccctcatgagccagtgccgccgggtgctgcgggcctatgtccccgcccggtttgccgaccccctcaccgatgtggtccacctgacggccgacaccttcacccgcttcgtcaccgggcagctcattgaggcctgtatcctgggcgggctgtgcgcggcggggatgctcttcatccaggccgactacgcccctctcatcggcgtcatcatcggcgcctccgccatcatcccggtggcgggcgcctacatcggggccattgtgtccgccctgctgctggtgatggtttcccccatcaaggccctggtcttcctggtctttctggtgatcctccagcagattgagggcaacgtcatctatcccaaggtggtgggcacctccatcggcctgcccggcatctgggtgctggccgccgtcaccatcggcggcggcgtgggcggcctggtgggcgtgctgctcagcgtgcccgtggcctcggtgctctacgccctgctccgccgggatgtgcacaagcgtctggcctgcaaggaataaacgaacccccggaaccgacgcggttccgggggttcgttttgctctgctcagtccaccagcttgtccagctccttgatgtgctcggtttcgtcggaggtcttgtgcttggcctgccgggcgtaaaggccaacggcggcctgggacttcttgatgggctgcatggtaccggcgccggccacgcagccgccgggacaggccatgccctccagcagatagccggggtacttgcctgccaccgcctcctgcatcatcttgcggcactcccgcaggccctgggagctggtcaccttgacctcccggccggggtagcggtgctggataacgttgaccactgccttggccacgccgccgcccacggcgaagctgcgcccgtcggtagaggcatcgttgacgccgtccgggtcctcctcgatggtggtcagatccacatgcttggccgcaaagatccccgccatctcctcaaaggtgagcacgaagtccacctcgctgcgcacgctcttgcgcatggcctccagcttcttggccgcgcagggcccgatgaacaccaccttggcgttgggatgctcgtgcttgatgaggcgggcggtgagggtcatgggggtgagggccatggagatgcagtgggcgtggtcggggtggagcttcttggccatgaccgaccacgccgggcagcaggacgtgcccatgaagggcagctcctccggcacctcccggacgaagtcctccgcctcctgggtggcacagaggtcggcgccgatggccacctcaaagacatcggcaaagccgagctgcttcacggcggcgcggagcttgccgggggtcaccttggggccgaactggcccacgaaggcgggggccaccgcggcgtaaacccgctcgccggactggatggcccggatgacctggaagatctgggacttgtcggcgatggcgccgaaggggcagtttaccaggcacatgccgcaggagacgcacttgtccgggtcgatctcggccttgccattggcgtcggttccgatggcgtccattccgcaggccacggcgcagggccgctcctgaatgataatggccctgtaggagcacacgtcggcgcagcggccgcagttgatgcacttgccggggtcgatgtgggagcggccgttgtagcggtccagcttgatggcgtccttggggcagacctcctcgcaggggtgggccaggcagccctggcagccctcggtcaccagcacccgcttctccgcgcagccgttgcaggcaaacttaatgacgttgatgagcggaggggtgtagtaggtctccggccggtcggccgcctcgatattctccgagagcggggcgtgctccgccgcgctccggcagggcaggcccatggccagccgcagccgctcgcccacgatggcccgctccaaaaacacgtcgttgcggaagttgcccacctcgcccgggatgatcttgtaaggcaggctctcaatgcgcttgtccaccggccactccgtgtggtaagccatgcgggccacctcccggaacacccggtggcggatctcctggatacgggtttcgacacctctcatctgctctctgtccctttctgtatcggcccggccccgaggcggggcaggccggaatcggttgctttttgacctctccaatcataaccgtttggtaagtgtcctgtcaatgaaaatgtttccttgtcttaccgtattttgtacccgtttttctgaaaaccatgcagtttataccccatcgtttgaaaaaatgtgatatactctagccaaatgacacccgggagggatctctgtgaagccggaactgctgcgtgcgctgcccaaaatggatctgcttctcgcccgccccgccctggcgggcagccccctgccctacgccctgcggcggcaggcggcccgccaggtgctggacgagtaccgcgccgccctgcgcgccggggcgctgtctgccgtccccggcctggatgagctggagcagtccgtcctccgccggggcgcggagctgtcccggcccgccttggggcgggtgatcaacgccaccggcgtggtgctccacaccaacctgggccgggcccctctcagtccgcgggcggtggcggcggtgggagaggccgcccggggctattccaacctggagtacgacctctccgcccgccgccggggccgccggggggcggccgtcgagtccctcctgtgcgccctcaccggcgcggaggcggccctggtggtcaacaacaacgccgccgccgtgtttctcctcctctccgccctggcggcggggcggggggtggccatctcccggggggagctggtggagatcggcgggggcttccgggtgcccgacatcctggcccgcagcggggcccggctggtggaggtgggcaccaccaacaagacccgcccggtcgactacgccgccgccctggacgcgggggaggcccaggtgctgctcaaggtgcaccccagcaacttccgggttgtgggcttcacccaggcggtctccctgccggagctgggcgctctggcccggaagcggggggtgccgctgttctgcgacctgggctccgccgcccctggctccccggagctggccggggcggtggcgtgggccgatgtgtgctgcttctccggggacaagctgctgggcgggccccaggcagggattttgctggggaaggcggaaccgctcggccgtctgcgggccgaccccctcttccgcgccctgcgccccggcaagctggccctggccgccctggaggccaccctgctggactggcggaacgggacggcggtgccggtgtccgccatgctctccgccccgccggaggagctgcggcggcgggcggaggccctggccgaagccctctcccccctccacccctgcacggtggtggagactgcgggggaggtggggggcggcgcccggccgggggagagcctgcccgcctgggcggcggccctggagccggcggaggcgctggaagcccacctccgcgcctggcgggtgcccatcctgggccgcatccaccgggggaagctcctgctggacgtgcgcaccctcctgcccggcgacgaggcggagatcgccgccgccctggcggcgtggagggaggagagggcatgatcttctgcaccgcaggccatgtggaccacggcaagaccgccctggtgcgggccctcaccggggtggacaccgaccggctggccgaggagcgccgccggggcctcaccatcgagctggggttcgcccccctggagctgccgggagcggggcgggtctccctggtggacgtgcccggccacgcccagttcatccccaccatgctctccggctgcggcgggctggacggcgcgctctttaccgtggccgccgacgagggccctatgccccagacggcggagcacctggacattctctccctgctgggcctggagcggggggtggtcgccctcacccgggcggatctggcctcccccgccgccagggcggaggtggaggcgcgcacccgtgccctgacggcgggcaccttcctggagggagccccccggatcttcgtctccgccgtcaccggcgaggggctggaggcgctgcgggccgccctggcggccatggcccggcaggcgccgcccccgccggagggcagcccccggctccacgtggaccgggtcttttccgtggacggcagcggcacggtggtcaccggcaccctcaccggcggccccctccgccggggggacagggtgcagctctatccgggagggcagaccgcccgggtacggggccttcagtgccacggcgtcccggcggaggcgctgccccccggggtgcgggcggcggtgaacctggcgggggtgcgcctgcgggacgtgggccggggggacaccctggctgcgcccggcgccctcgccctcaccgaccggaccgacgtatccctgcgggtgctccccgacgccccctttcccgtgcacaccggaagtcagctccacttccaccacggcgcccgcgccctggtgtgccgctgcatcctcctgggacaggacgtgctccgccccggcgaggcggggtgggcccagctccgcttcacccagcccgtcgccgccgcccccggcgaccggttcgtggcgcgcttcttctcccccctggccacggtgggaggcggcgtgctggtggatctgtcgccccccggcaagggccgcatgcggccggagcggctggcccggctggccgccctggcggaggggcggcccctcccggcgatggaatcccccgccgccccagaggctccggcggcccctgccccgtcggcggaggcggagggggagctggaggccctctatctggggtacggcctggagccgcccccctgggcgcgggtggagccccgctttgccgggcggatcagggaggcgcgccgggcctgccgccgcctgaaggagcggggcgtcctgctggagctctccaccggccatctgctccacgccggggccgtccgggcggcggaggcccggctgcgcgggcgcttccgctccgcctccttctccctggcccaggccagggacgccctgggttgttcccgccggtgcgccctgctcctgctggagcactgggacgcctccggcgtcacccgccggcagggagagggccggattttttccacatctgcttgacccacagtggaaaaccagctatgatgggagtggatatgggggcggaagggccgctggtgggccccccggtcttcaaaaccgacggggacggcgctcccgtcctggtgtgttcgattcgcacccgcccccgccacgggctcagaaccgcccttttggcacgaggttccgccgggatggcgaaacctcttagccgggccgggcggttcttcgcctccaaccgcgacccacgttgttgggctcgcggttggggggccgccctgcgggcgtcggttggaaacaaggccttttctgtggaaaggagtgcgccgttatgtccagtatcccattctttgcccgccgcaggctctgcagcaccttcaatgcccaggaggtcggacagctccgcgccgccctccagggcgcgggggtggagtttgtcatccagcaggaccgccagaacggttcctttttcggcatcggcctgcagttggtccccccctccgttgaatacattatttatgtccatgaggacgactttgagctggcccaggccgcccttcagggcaccctcaactgaaaaatgcccgtgggcggccgtcggaagaggtctctttttatcgaaaggagcgtgccgtcatgtccacgattcccctcctcgcccgccgcaggctctgcaacaccttcaacgcccaggaggtcggacagctccgcgccgccctccaggatgccggggtggagtttgtcatcacccaggacagccgcccggtgggcggattctccggctatggaacctccggaccagccctccatctgggggccggcgcagcccccttcgagtacacggtatatgtgcacaaggatgatctggccctggccgagagcgccatacagggcaccgtcggatagcagcacagagccgccgccccagtcggggcggcggctctgtttttccatatgctccatgctccccgcggcgtcagctccttctcctccatttcagcagcagggcggagttgaggatcaccagcacggagccggcgttgtgaaccagggcccccaccacggggttgaggacgccggtcatggccagcacgatggccactaggttgagggccatagagaaggccaggttgaggcggattgtggtcatcatccgccgggacagggccagcaggtggggcagctcctccacccggtcgttcaccagaacgatgtcggcggcgtccacggcgatatcactgcccacgccccccatggcgatgcccacaaagacccttttcagggcgggggcgtcgttgatgccgtcgcccaccatgcagatccggacgcccgcctgctgggcccggtcgatccagttgagcttgtcctccggcagacagcccgcccggtactcccgaatggacagcgtccgggcgatgtgggcggcggcgttctcgttgtcgccggtgaggagcaccggggacaccccctccgcgctcagggcccggagcatggccgccgcctctccccgcaccgtgtccgccagggcgcagaagccggcgggggctccgtccaccgccagatagatgagggtgcagccccgggccagaaaaccctccgcctccgctctggccgccgggggaagggccgcgcccgcctcctccagcagggcctcgaagtcctccgccggggcgggcgtcccgcctccggcggcctgccaccccctgaccaccgctttgcccagggggtgctccgagcccagctccgcccgggccagccaggcgtagacctgttcctccgtcacgccgggggacaggctgcgcaccgccgtcacctcgggcacgccgcgggtcagggtgcccgtcttgtcgaaggccgccttgcccacctgggccagccgctccagggcgtccccctcccgcaccaggaagctgtggcgggtggcgttgccgatggccgccatgatagcggtgggggtggccagcaccagggcgcaggggcagaacaccaccaggatggtcaccgcccggatcacctgaccgctgagcagccacgtgagggctgcggaagcgagggcggcgaccacgatccaggtggcccagcggtcggccaggcccacgatcttcgccttgcccgcatccgccgactgcaccaggcggatcatccgctggatggagctgtcctcccccacccgggcggcctccatctcaaaggagccgaactggttgacggtgccgctgaatacctcgtctcccggccccttgtccaccgggagggactcgccggtcatcaccgcctggttgacggaggtctgtccggcccgcaccaccccgtccaccggaatggtctctccggggagcacccgcagccggtcccccaccgccacggcctcggcggggatgctctcctccccggcggcggtcacccgccgggcggttcggggcgtcagccggaccagcttttcgatgcccgcccgggccttggccaccgtccgctcctccagcagagagccaagctgcatgatgaaggcgatctcgccggcggcaaagatctccccaatggccaccgaggcgagcagcgccagggacaccagcacgtcggccttgatgtcaaagcgggtgaacagccccacggccgcctccctgacaatgggcgcgccgcagagcaggatggccagccacgccgggttcaccggcagggccgccggggcaaaaaagctcaacaggagggaaccccctcccagcgcaaggaatgtgatatcccgtctcatatacccataccccctataggtatatttatacccccatgggtattatttgtcaagaaaaaagcggcccaaacgggccgcatcagcgtcagctcatacgtgagaagtgctcgatggctttggcgaattccgcaatggtccggtccgcgtctccgtgctcgatgccgtcccggacgcagtggttgagatgcccctccagcaccacctgtcccaccttgtgcagggcgctcttggcggcgttgatctgcatcagcatgtcctcacagggcacgtcctgatccaccatcttgtcgatggcgcccaactgcccgatgatctttttcagtctgcggtggaggttgtccgcatccatacactgtctcaatggcttcacccactttctttgctatgataccagcttttcgcccgcctgtaaaggcaaagcgggaccggcgcggcaaggcgcgccggtcccggccggtgaaagctcagctccgctcctcaaagctggcgccgcagttgcggcagttgacggtgatcttccccttcccccggggcacccgcagatactgtccgcagttggggcacttgaagtagcggtgctccttgtcccggcggatggtacggcgcatccgcagccagcgtatggcgggtccggccagagccagaaaccgggcgttctccgcccggcggcggtcgatgcggcgggagaacatgcggaacagatcccacaggagcactgccagcgccagccaggagagcgcctccaggtggggcaggccggacaaaagaatgaggacgatatagaccacgaggaggaaaaaggagagctggtcgcttccataccggccgtacatcaattttcgaatgaagttcatcaccatgaaatacggtcgtctcctttgaagttaaaaataaattttttctgaacttatgatagcgcctccctgtttcttcgtcaaggaaggaaacgtaaacaatatgtgaattgtccgcccggggcagccattccggggcttgcgggatggcggaaaacccggtatactggtaaaaaagcatgggaggggcgtttatgggacgcatcgacaaggagaattactatctggacatcgcccagacagtggccgggcgctccacctgcctgcgccggtgctatggggccattctcgtcaagagcgacgagatcatctccaccggctacaacggcgccccccgtgggcggcgcaactgcgtggatctcagctactgcacccgcgaggcgctgaacatcccctccggggagcggtacgagctgtgccgctccgtccacgccgaggccaacgccatcatctccgccgcccgcagcgaggccctgggcgccactctctacatggcctgcgtggagccggacaccggggcgctgattcccggctccacctcctgctccatgtgccgccgcctcatcatcaacgccggcatcgagcgggtggtcatccgggacacccgcacggagtaccgggtggtggaggtggccgactgggtgcgggaggacgactccctgccccgatccctttgaggcccagagccgcagaaattgattccgaacaggaatgttcttgacagaaggccgccacagacttaaaatagataaggtgtaatattttgaagaacgaggggtaagctcttcaaattttgtgcgctctgcccaagagcgggcgggagcgcgtgcatccatttcatgaaaaagaactttgaaaatccaagatatggaggtgtgttggacccttgatcgagattatcatcgcctgtgtgatcacggccgtggtcgcactcatcataggcattcccatcggcattcaaatccgcaagcgcaccgcggaaaaagagatcaacagtgcggaggaggaggccaagcgcatcatcaacgagtccatcaagagcgccgagagtaagaagcgggaggcgctggtggaggccaaggaggagattctccaggcccgcaacgagtatgagcgcgaggtgaaggagcgccgggccgatctgcagaagcaggagcggcggctccagcagaaggaagagaacctggaccgcaagaccgagaacatcgagaagaaggaggacaccctgcagcgcaagctggccgagctggacgaggcccgggacgaggtggccaccgtcaagaagacccagatggaggtgctggagcgcatctccggcttcaccgccgaggaggccaagaactacctcatcaaccagcttgccgaggaggtcacccatgagtcggccatgaaggtgcgggagatcgaggcccagttcaaggaggaggccgacacccgcgccaaggagatcctgtccctggccattcagcgctgcgccgccgaccatgtggccgaagccaccgtctctgtggttcccctgcccaatgacgagatgaagggccgcatcatcggccgcgagggccgcaacatccgcacgctggagaccatgaccggcgtggatctgatcatcgacgacacgccggaggccatcaccgtctcctgcttcgacccggtgcgccgggaaatcgcccgcatcgccctggagaagctcatccaggacggccgcatccatcccacccgcatcgaggagatggtggagaaggccaagcgggaggtggacgccaccattaaggccgagggcgagcgcgccgtgttcgagaccaatgtccacggcctgcaccccgagctcatcaagctgctgggccgcatgcgctaccgcaccagctacggccagaacgtgctcaaccactccatcgaggtgtcccacctggcggggctgatcgccgccgagatcggcgccgacgtgacccaggccaagcgggccggcctgctccacgacctgggcaagtccatcgaccacgaggtggagggctcccacgtgcagatcggcgtggagctggcccggaagtaccgggagaacgaggacatcgtgcatgccattgaggcgcaccacaacgacgtggagccccgcaccatcgtggcctgcatcgtccaggcagccgacgccatctccgccgcccgccccggcgcccgccgcgagaacctggagaactatatcaagcgtctggagaagctggaggaggtcacctcctccttccccggcgtggagaagtccttcgccattcaggccggccgcgaggtgcgcattatggtggccccggacaaggtcagcgaggatcagatggtgctcctggcccgggacatcgccaagaagatcgaggaggagctggagtatcccggccagatcaaggtcaacatgatccgggagaccaaggtcatcgagtacgcgaaataagatacgcacgggaggggctgctggacagcccctcctttgttgaaagcggggagtttgcccatgaaaaaaccgaaaaaagaagaaaagcccctcagcggcgctcaggatgcctacgagtggcttcagattttgattgtggcgctggtgaccatcatcctggtattcaccttcgtggggcgcatcaccccggtggtgggggagtccatgctgcccaccctccacgagggggatgtgatgctgatccgggacatcggctacaccgatccccagccgggggacatcgtggtgctcaccaaggagtttgacgccgccagggggcccattgtcaagcggatcatcgccgtggagggccagacggtggacatcgactaccagaccggcaccgtctatgtggacggcgaagccctggacgagccctatctgaacgagcccatggaggagccctggtatgaggatctcacctccgtgacggtgccggaggggtcggtcttcgtcatgggggataaccgcaaccactccaacgacagccgggacgtgaccctgggcaccgtggacacgcgctatctgctgggcaaggcggagttcatctgcttccccttctccgacttcggacgcatcggctgagggaggcggccgccccgcccggccggggatcatacaatcgcgggccgcaggcaatgcctgcggcccgcgattgattttgtcctattttccaaacagccggcccaggaaggacttctttttcttcggctgttccgccgctccggcgggggtggccttgtccagctcctccagctcctccttggcgtcgaagcccaggtcaatggccttttggtagcacgtccgggcctgtgccgcgtcggcctccacgccctggccctcccggtaacagtcacccagcaggcacatggcccggccggagccgccttcggcggcctttcggaaccaatacaccgcctgcgccgggtcaggccgtatgccgatccccttgagcatgcagtagcccaggttacactggcccacggagctgccctgttcggcggcctggcggtacagcttcacggcccgggccttgtcctccttcacgcccttgccgctctcatagcagtagcccaggttgcactgggcgcggggatagccctgctccgccgcccgctcgtaccactccacggccttggcggcgtcctccgctacgcccacgccccggtcatagaagaagcccaggttgcactgggccggggcatacccccgccgggcggccttctcataccactccgccgccttagtcttgtcctccgccacaccctcgccgtactcatagcacaggcccaggttgcacatggccctggggtgctcctgctcggcggccctggcataccactccacggccttggtcttgtcctccgccacgccgatgccctgctcgtagcagtaggccagattacattgagcggtggcatggccccgctgcgcggccttttcgtaccactccaccgccttggtcttgtcctccgccgtgccgctccccacctcgtagcagtagcccaaggcgcactgggcggggggatagccctgctccgccgcctgggtatagagctggaaggcccgcgccgcatccatttcggtgccctccccgtcccggcacaggtcgcccaggatgctctgtgcccgggcattcccctgggccgccgccttctccagccaccgcacggcggcggccgcgtcccgctccactccgttgccgttgaggtagcacaccgccaggttgcattggcccggggcatagccctcctcggcgctcttgcggtaccacagcaccgcatggcgcagatcctcttccacgccatccccgttctcatagcacagccccaggtcgcacatggcgggcacatagccgcccttggcggcggcccggtagagctccacggcccgggccttgtcctcgggcacgccgttgccggtgagcagcagatcccccagaatcccctgggcccgcgggaactcctgctctaccgccttttccagccagcctacggcctcctccgcgctccgttccgcgccggtcccgttgagcaggcatacggccagattggtcatggccggggcatagccctccccggcggccttggtgtaccagtacaccgccttggccgggtcttcggtcagtccctcccccagctcgaaggccagccccaggctgcacatagcagggggatagttctgtttggcggcctttccataccactccgccgcctgggccgcgtcggcctccacgccgtcgccgtcccggtagcagcttcccagcaggctctgggcccgggcctggccctgctccgccgccttctccagccaggggatggccttctccggcgccgcctccatgccgatgccggtgagaaagcagtaagccagattggtctgggccggggcatagcccccctcggcggccctggtgtaccactccaccgcctgggccttgtcctccgccacgccgtcgccggtctcatagcacaggcccagactgcatatggcgggcaggtagccgtccgccgcagactcccggtagagggagagggccctctccttgtcctgctccaccccacggccatccaggtagaagtcccccaggatgctcttggcccgggcggagccgccctccactgccttctggaaccacgccaccgcctgggccatgtcctcctccacgccgatgccgttgagatagcacaccgccaggttgcacatggcgggagcgtagtcctgctccgccgccttccgatagcactccgccgcctggaccttgtcctccgccacgccgttggcgttctcgtagcacaggcccaggtcgcacagcgctggggcgtagccctggtcggcggcctgccggtagagctccgccgcccgggccgggtcggcctccacgcccttgccgtccagatagcagtcgcccagcagatcctgggcacgtgcgaagctctgctccgctgcccggcggaaccactccgccgccgcggccgggtcggcctcggtgcccacgccgtggagcgtgagcacgcccagattacactgggccggggcgtagtcctgctccgccgccttccggtagcactccaccgccttggccttgtcctgctccacgccgtccccgtgctcatagcacaggcccaggttgcacagggcggggggatagtcctgctcggcggcctgccggtagagccgggccgcctccccccggtcctgctccacgccggtgccgtcccagtggcagtcgcccagaatgttcagcgcccggggaaacttctgctccgccgccttctccagccactggtgggcgcactccacatccttgtccacgccgattccgttgaagtagcacaccgccagattggtctgggccggggcgtaatcctgctccgccgcctggaggtagcactccgccgcccgggcctcgtccttctccacgccggagccgttctcatagctcaggcccaggtcgcactgggcgggggcgtagtcctgctccgccgcctgctgaaagagctccgccgcccgggcctcgtccttctccacccctgcgccggactggtaacagcgccccagcaggtcggtggcccggagatccccgtcctccgaggccagggcaaaccagcgggccgcctgggctgggtccttgtcggtcccgtcgccctcggtatagcgcacgccaaggtcgtaatagacggaggcgtctccgccctccgcctgctccagcagggtctggaactcctcgcgggcgcgctggagtccctccaccgccttctgaatcagatgggtatccacaaaaatgacctgctgatcctcgaaggattcacggttattgttggcattcgtgtccatgaccgttccccaatctatgtagtatggggatattatacgccgcccataggattttgtctatggcggaaaagaggagaaccctcccggcaggtgagtctgccggtaaacgcttttgccaagcgtttcggagggaaagatcatgtgaaaggctgctccgcccggtggggccggagccccgccgggcgggtgtgtgatctagggcagctcgatcacccagttcagcgggtcataagtggatgtatacgaccgggtctccacctcccgcggccggtcggtgcgcagaatgttgaaaaccagcgcctccacctcgatagccgtaatcttcccctctggctcctccagcagccggaactccggccagtactcctccgccgggccggggaagacccggtatcgctcgtagcggttgcccgcctcatcggtgacccacgcggcgggcatgtgccagatagaacagccccgatagcggttgcccgcctcgtcgatgaaccatatcgccggcacaggctggacacggcccgcctcatcctcagaatagagcatgggcacccatagctgttgcagcttctcctcccgggccgccagggcggggctcagctccccatagaaagccacgctgtgcccgtcgtcccccaccagggcggtgacggtaccctcccggaaggtgcggctgacggagacggcgtccagagtctggggggtatccagggccaggacgcccccctcccacatgggctggtagcccagatgggagacgtcgttggagtacacctccacgtcgaaggtatagggccccttcgccccgtcgggcacctccatgtgatagatctcggtttcgccctccgtgtagccctgggcccaataggtgcggctcatccagtcggcaaggacatccaggcggctggggtggtatgtcgtcccctctgttaaaaaaacgggggccgacatctcacccttggcgtcgtcatagtaagaggacacccgccgcagcttcttcccgtcggcgtcgtataccagcaggcggtagcgcagctcctccccctcggccagcgccccctctctggtaaaaacactcaccggcacagtgagcatcccatcccgctgataggccccgccgatgcggtagaggaacgccccgtcctccttgtggagtgcctccccctgcaccagcagggagaggttctcctccgccgcccccacccccaggaagtaacggatcacccgctctgtcccggcggctacggcctgataatttaccagtcccagcaccagccccgcgcaggccgccagggccgccacacgccgcaggggtatttgccgtctgggagccggccgccgggcctccagggccagcagcgcgccgtcctccggctccggcacctccgccgccaggtgcaggccctcctccagcggcgcccggcggcggaaccaggcgctctttttccagttcttgcaggcgttgacgctcagccgcaccacccacgcccgctcctggcccaaatcggggaagcgacggccctcctctaccagcttgatgagcaccgtctggcagatgtccttggcgtcgtccatgtcccccagccaggtgtagccgatgcggaggatggcgtcggcgtaccgctccaccagctcctccgcccgcgtcccgtccatggcctcgccccctttcacctctataacaacacaggcgggccggatctgtcaattccgcgtaaaacttcatgcgcctgggacgcggcagggggcacacggccaattttgctccgcctttgcacagcaaaaaagcggcgcggcaagagccgcgccgcagcctgccgaacgcgtttttcgacggcctcagcgggaaatcgcaggggcggggctcctccccgtccgcaggcggccacaagggccgcccctacagtcgcgcgccgcgtgctgcccgcgcggcgatacgccgggccctgtcactccagggtcagatccccctccttgatccacccgatgcgccggaagaagaggccgaacagccagcagagcaccgcagggaggacaaagcagatgagcgccagcccaacccagtccagggaggtgatggccgccttggccccggtggccacatcgttgacccatccggcgtacaccccgatggggcccaccatgccgcaggtgcccatgccggaggccacggcggaagccgggtcgttcatctccagccggaacaggcaggtggccagggggccggtgatggccgaggtgaggatcgcaggcagccagatgcggggattgcggacgatgttgcccatctggagcatggaggtgcccaggccctggctgaccagcccgccccagcggttctcccggaaggagagtaccgcaaagcccaccatattggcgcagcagcccgccacggcagccccgccggccagccccgtcaggccgatggcggcgcagatggcggccgacgagatgggcagagtaagggccacgccgatgaccaccgacaccagaatccccatccagaagggctggagcacggtggcccacttgacaacgtcccccacagcggaggccgcggtgccgatggccggggccagcagggcggacagtcccactccggccaggatggtcaccaggggtgtgaccagaatgtcgattttcgtctccttggacaccgccttgcccagctcggcggcgatgacggcgatgaagagcaccgccagcggcccgcccgcccccttgccgccggacagggtgacgctgcccagggcgttggcggcatagcccaccgtggccagggaaaacagcaccaggggcggcgcctggagggcgtagccgatggccacggccatggccgagccgctcatggcggaggcgtagccccccaccgtcaccaggaaggcaatgccgagctgcttacccagcgtgtccagaatggtgccgatgagcagggaacagaacagcccctgggccatggctcccaatgcgtccactccataccgctttgccgagaggacaatattttttcgcttgagaaatgcgctgcatgctcccatatttccgtctctcctttacatgtgtcatgacacataacttgtcttattatagcggaacaggcggatttgtcaagcaaaaagcgcgggacacgtcccgcgcttttggaaatcacacataccccagcagcccccggacggacacctcgccggaggacaccgcctcccggctgccgtcggcgcggcgcaccaccagggcgaaggcatcgtccaccgcctcggcaaaggcctcctcctcctcgcccgcccggagcaggcgcaccgtccggcccagggtgagacagtcggcccggtaccgctccagccaggccgcccgctctgccgggaaggcggcgtacagctcgtccagggcggccagcacggccgccgccatctccgcccggcggggggcccgtcccagagcctgggccagggagacggccaccggggccacctccggcccgaagtcggctgcggtctgggtgaggttgatccccacccccaccaccacatggcgcagggcggcagtctccgcctccagctccagctcggtgagaatgccgcacagcttccgcccgtccaggatcacgtcgttgggccacttgatccccggccgcacgccgcacacccgctccaccgcattgcacaccgccaccgccgtccacgccgtcagggtcgacacctcctccagagggcaccgggggcggaggagaaccgacagataaagcccctgccccgcaggggagacaaaggagcggccccggcggccccggccgccggtctgctgctccgccaccaccgccaggccgtcggcggccccggccagggcccggcgcttgacctcgttgttggtggagtccaccgtctccaggcacaccagcgcgcggcccacccggcggcccgccagggctccggccagctccccggcggacagccggtccggcgagccctccagggcgtagccccggcggggggcggaggagatgacatacccctcgtcccgcagagactccatggccttccacaccgccgcccggctcacccccagggcacggctcatctcctcccccgacaggggcttcccctcccgggcctttaacagcgccagcacctcgtcccgcagcattcgctccacttcctttcgccctctattgtacccgtcccctcctaaatcgtcaacctatatctctttttagttgacattttattaaatgtaaactataatcatttttaagtttacaatcaggagggaacacctatcatgaagacaagagaactggcctacaccggcatcctggcggctctgatcgccgtctgctcctggatctccatccccaccgccgttcccttcaccctacagacctttgccgtctttctcacactgggcctgctggggggcaggctgggcaccctggcggtgaccgtctatctgctgttgggggccgtgggactgcccgtctttgccggcttccacggcggcctgggggcctttctgggtgccacgggcggctatctggtgggcttcctttttaccgccctcaccatgtggggcgccgagcgatggctgggaaaatccgcccccgtctttctcggttccgccgtcgtgggtcagatcctgtgctacctgttcggctccgtctggtactacgcggtatacaccagctccgccgggccggtaggaatgttcaccgtgttgggctggtgtgtgttccccttcctcctgcccgacgcagtcaagctggcgctggcctggctgttgagccgccgcctggcccccgcccttcggatcagccgccgctgagggccctggcataacccgcccacctgtcccatatatatgagacaagactatggaaaggcgggggagagccatgccgtacgaagaaaaccgtccgcgggcggaggcggcccatcacatcattctggaggagcgcgaacagctctcagtctccggcgtggaggaggtggagagctttgacgagaacaccattgtcatgctcaccaaccggggcaccctcatcgtgcggggggaggagctgcacatcgagaagctgagcctggacggcggggatttgaaggtggagggcaccatcgactccctcacctacgaggacagcgggcgggacagggcgggcggcctgtttgcccggctcttccgctgaaatgaccgtatccgtcaccgaccaggccctcttctttgccggggcgctggtgatgggggcggcggtggggctgctgtacgacgcgttccgcatcctccgtgtgcgcgtccgcctccccctgctgggtggagtgctggacctgctgttctggctggtggtcaccgtcgccctgtttgtctacaccaccaccgccggcagcggcgaagtgcgcctttacattgtggcggccgtcctcctgggcgcggcggcttatttctggctgctgagccgctggttcctcaaactgggctaccgtctggccgatctcgttggggttttgtggcgtgtgcttacactaccggtagtgtttctcctgaggctgtgtaaaaaaatcggaaaaaccgcaaaaaagtccttccattatcggcgaaagtggtatagaataaggctgatatccagggaaatggatgagctgcaccgctcggaccgccgcgcgtcgggaggaggtaccgcctgtgaaaaccaaaaaagcgtccctcctgaccaagctggtggtactggccctgcttatcggcgccgccaccgggctgctgaacctgcgccagcagattctgaccgcccagagcgacctggccgaggccgaggcgcaggtggcagcccagaagcaggtcaacgccgacctgtccgacgccgtggaaaacagcgatgatcccgaccggcaggccgacatcgcccgcggcaagctgggcctggtagagccgggcgagtatatcttccgtttcaccgattgaaaatttatgagagaggatttagcagtcagtatggagtttggtgttggttcggttctggaaggaaaggtcacaggcatcacaaagttcggtgcgttcgtctccttgccggagggcaagtcgggtctggtgcatatctcagagatcgcctattcctatgtcaacgatgtgaaggatcatctcaaggaagggcaggaggtcaaggtcaaggtcatcggcattgacgagaacggccgcatcaacctctccatcaaaaaggctatggatcccccgccccgccccgcaggccagggccgtcctatgggccgccccggcgggcacaccggcggcggcttccgcggcaagcccgccccggcggagcccgccagctttgaggaccggctcaagcagtttatggccgcctcggacagcaagctgtccgagctgcgccagtcggagcgccgcagctcccgccgcggcggccgcaagtaagccacaaaaaaacagccctcccatatgtgggagggctgttttttgctctcagcgcggcgggggcggtccgccctcacagcagttctttatacagggcgggggcgtcggccttgcccacgtgctcggccaccgacagcacctccacctttacggtgcgctcgccgaagcgcagctccagcacgtcgcccgccttcacgtcgtagctggccttcaccggccggccgttggccgtgacccgggcgttgtcgcaggcctcgttggccaccgtccggcgcttgatgagccgggagaccttcagccatttgtccagtcgcatgggaatcttcctcctccatagtcaacatagtcaagggccgccgcaagcctgcggcggccctgtggttctctctgtggatgcggcccagccggacatggggccactcgcctcacgggcgggtgtgggcacccgtccctacgcctccgccgggcccggtgcagcgccgcgggggaaccattctgtgcacccctgtaggggcggcccttgcggccgcccgcgggcggggacaagccccgcccctacaacacggggtacgtcccctttcagggccctcgccgcgggttcggtgggaagatgaggccgaggcgccgcctgcggcgaaagggcctcctgggcacccactcctcttccgcgcgtaggggccgatgccctcatcggcccgcgggcgggtgtgggcacccgcccctacggcgcagggcgctccccaccttcgtggcccccgcgcgaacccagcgaagcggttcgcgtggggaaaaggaggcccagcggcgggaatgagcgttcgggctcgcccggaagcgagtgatccaaagcttgggctgacgctgtcacgctgcggcggctgcgcgacgccacactgcttacccctccgtgaaaaacaccttgcgcctgcggcgcaactgctttttcgtctgcggggctcgctgtgcggctgctccgcgcgcctccgcgcttcctgtcacgctgcgggttgggcgcatggccgggtcgctaagcggccattccgcgaaaaatgccgccgggcttcgcccggcctgttttttcgcctccatgtcctcttagctcccctatgcgcctaccctccgcgcttctgacttacttcgcgacgatgtccttcagcgccttgccgggcttgaacacgggcaccttggaggcggggatcttgatgctctccttggtcttggggttgcggccgatgcgctcggcgcggctcttcacctcaaaggcaccgaagcccaccagttgaaccttgtcgccctcggccaggcagtcggaaatgacctcaatggccgcgttgatggcggtctcggtatccttcttggacaggccggccttctcggcggccgcattgatcagttcagccttattcatatcgataactcctcctgtgtttactgggggaatcaccccagtctgattatacttaaggcgaacccgcccttaagtctcttttgcgtgctcccatagcttgtccaattccgccaagctcatgccctccagggcgcggccctgccgggcggcctcctcttccaccttgcggaagcggccgatgaacttgtcggtggccccgttgagggcctcctcggtgtccaccttcacgaaacgggagacgttgacggcggagaagagcagatcgcccagctcctcctccacattggtgccctcggccacggcggtcttcagctcctccagctcctcagacagcttgtccagggcgccggacacgtccggccagtcgaagcccgcctttttcgcctttttctgcaccttctcggcccgccacagggcgggcagggagcgggccacggcctccagcgcgtcggtattggtggcctgccccttttccttccgcttgagctcctcccagttggagagaacctcgccggtgccggagaccgacacctccccaaagacgtgggggtggcggaagatgagctttttgcagatgccgtcggccacggcgtccagatcgaagcgaccggcctcctgctccataagggcgtggaacaccacctggagcaacacgtcgcccaactcctccttcaggtgctcggggctgccctcgtcgatggcctccacggcctcataggcctcctccaggaaattgcggcggatggactggtgggtctgctccgcgtcccaggggcacccgccgggcgcccgcaagaggcggacaatctcctccaagtccttgacgccgtaagaatccttatactgaaaatctaccatatttcaaggcctcctgcaacctctttttccaaaaaacttactggatatgcagaattttagccagctttttgcccccgggcatcatttccaggtcctcccgggtcagggtacgcagagccaggactaaaattacatataccaccacgcccaccaggatcgctccggcggtggccgccatatcccgggtcagactgccgttcaggacacgggcgagcaacccatggcttccccatgcggcggcagccattaccacggaggccgccagcggcttggacagcgccaccagatagcggggcggattgggcacgcaccgcttgatgatgagcaggttgagaatggagatcaccgcaaagcagctcagagtgcccaccggcgcgccgaagatcatgattttgggattacccaccagggtgtagttgaccagaatcttagtgacgccgccgataataaccgtaatgatgggcagattcactatgccgttggcctggaggatcgcggtgcccaccaactggaagcagacaaaaatggaggcaatccccaggatggacaggatgggaccggcgatggccgtatccacattgcccagggcgatgagttccataatggggccgcccagagccagcagaccgaagccgcagggcagggcaatgagggcggccacccgcatggcggactcggtaatccgcttggctcccagccggtcgctccgggccaggcaggcggagatgccggggacgatgcaggccgtcagggggatcatcaggttaaagggcaggttgtagacgctcatggtcttactgtaggtgccgtagaggctgcgggcagagtccaggatcgggtccagcttggtggccgggtctgtcagcagggcttgctgccaggcatccgtattgttctgaaagatctccacagccttgggaaagatatccagaaaactgttgctgatgccggtcataccgccctggatggcggtaaacacattctggagctgattgttcaccaggttggtgtcgatgatagtcaccagggacatggagcaggaactgagggtgatgggaatggccagcttgagcagccgggccagtaccacccggctccggtcgggctggtcggcggcccgggcggcgctgccccggcgggtacggaagtggttgaaggccagatagatcaccgacagaacgctgccgaaggagacgccgatgagggcgccggaggccgccagccggttgcggatgtcctccggccagagggtcaggctcatgatcaccatggcaaggcccaaacccaggaagagcttgcacagcgcctcaatgatctgggagatcgcggtgggcatcatgttcatgtgcccctgggcatagccccggaaggcggagcagcagcaggtgcacagcaccgccggcgccagcgcccacacgcagaacacggctttctcattgccaatgatataggttgctaccagttgtccgaacactgacatgcagaggaagctgaacagccccatgaacaggaacgcacagaatgccacccggaagacccggtgcttctggttctcccggcccagagtatggcactccgacaccgtcttggacaaggcaacaggcaggcccgccgtggagatggtgaggaagaaggagtagatgttatacgcgccgttgaaatcgccgtaggcctcctcgggcagtatggcgataagcgggatcttgaagatggcgccgataatcttgaccagaatggtgctcaccgtcaggatagcggccgcgccgtaaaaggtattctttttttgctgattggacaatgctaggcccccttatttcgtttcaaacagcaggggcagggcgtagtccgccacttcccgcttcacccggtcaatgtcgatggtgaggaagtccccatctctgtatatgacctttccgcgggccatattcatgcacacgtcgctgccgtgggcggcatatgccaggttggaaatcacgctgtggcagggggtgaggttcaggtgggagaaatccaccagaatgaggtcggcgtcgtagcccccctcaatccggccagtgagccgacccagggccttgccgccgttgacggtggccatgcgcagggcgtcgatgggcagcagggccagggggtcgcagttggccccgttgtggagaatggcggccagcttcatgtccccgaagaagtcggtgcagttgttggaggacacgccgtcggtgcccaggcaaacgttgacaccggccttgcccatggcggggacgggggcgatgccgctgcccagcttgaggttgctcatgggattgtggatggccgaaacccccttggacgccataacggaccagtcctccggggtggtccagacgcagtgggcggcgatggcccgcacgtcccacacgccgtagtcgttgagcacctgaatgggagtcttgccgtggcgggccaggcactcggcatgctcggtgcgggtctcggagatgtgcacgtgcatacccaggccgtgctcccgggcgtagtccgccatccactgccagagcgggtggtgggaggtgtactcgccgtggatcgaggcgtccaccaaaatctgcccgtcgttgtagccgtgccacttctcggtcagctcccgctgcaccacacagtcgtggtgggtggcggggtcgaaggtgtcggtgaactgcacgccgccgcagcacaggttggcgctgatgccggaggccgccacctcctgggccaccgcgtcggtgtggccatacatgtccgcgatggtggtgacgccggaggcgatcatctccgccaggcccaggtcggtacaggcccggatggcccggtcgtcccagcgggcctccaccgggaagatgtagttgtgcagccagtcctggaggttgttgccgtcgccgtagccccgcatggcggtcatgggcacgtggctgtgggcgttgacaaagccgggcatgagcacgttgccccggccgtcgatctgctcctcaaaggagccccaggggcgctgggtgctgacggagcggatcttcgtcccctccaccaccacataggcgttggggaggacggtgcccgcctcgtccatgaggacggcggtgcagttatggatcagaatagacatggcaggctccttttagtcaatctttttcaggcaggccagcacgaggcgggagaacttgtcccggcaggccgccgccgcatccagcacctcctgctcggagaggggctggtccagaataccggcgcccatgttggacaggagggtaaagcccagcacccgcatgccacagtggccggcggtgatgacctccggcgcggtggacatgcccgctgcgtcggcgcccagcacccgggcggcccgcacctccgccggagtctcgtactgggggccggggaagtacatgtagacgccctcccgcagcccgatgcccagctccctggcggtctggcgggccatctcccgcagggcgggggtgtagaggtgggaggcgtcggggaagcgcacgccgaactcgggcaggttctcaccccgcaggggggactccatgaagaacttgatgtggtctgcaataagcatcagatcgcccgccttccagtccaggttgacgcagccggcggcgttggtgacgatcagggtatcgcagcccagcaggcggagcacccgcaccgcgtaggacacctcctcataggagtagccctcgtagtggtgcatacggccctgcataacagccaccttctgcccctccagggtgccgaacaccagctgacccttgtggccgggggcggtggacaccttgaaatgggggatattctgataaggcacggcaatggggttttccacaatatcgcccatgtagcccaggccggaacccaggatcatggccaccttgggggcaaagccgccgatctggctgcggatgtagtccgcgctctcctggtattgggcaaacgtgtagttcataaagcttgtcctccttatttgtaataagcggcccggacgggcccgaaatacggtctgacggttcgccgcaagcgctgcggccgcaaggattacatggtattttacaccccgcccgccaaaaaagcaatgaaaaagggcaacttcccgccccctttccgaaaaagccgcaaaaaagcgggacccgtccgggtcccgcctccccgcggctagagcggcttctcctgccggaggcgctcgagccggctccgcagctcggccgccgcggcctccttgtggtccagctccgagaacacctgctccagcgcgtcctctccgcccgtgctgccccggtgagcgtcgtacaccagccgccccgccgtatggagcaggccgttgatgtccgtccgaagggcgaacagccttccccgcagccgggccgtgtccaccatctgtccggcgtactccccggcggtggcggcggtctcccgcgcccgctccagcagctcctgtatccggtcgtccatatacccgtccccctgtctgtttccgttcaggccattctatgcaccggcggcagaggggtgcagaaaggcggcgctctcccccgcaggggagggcgccgcacttgaacgcacgcttatttcaggcactccgaatcgggtgggtgccggcagggcttacttcagccgctccgaaatcacctgggccaccttcacccccgacgcgcccgcctgggccgcgtcgtcgcaaagtccgcttgactccggttccgcctgacggcaaaacctgcgtccgctcccttgctcctccgctcccaccggcacccgcttgcgctgggttgccggcgggcaggggccgcctgcggcggccgttctctggagatgtcaaatctgcttcgagcactccgaatcgggtgggtgccggcgggacttacttcagccgctccgaaatcacttgggcgaccttcacgcccgacgcgcccgcctgggccgcgtcgtcgcaaagtccgcttgactccggttccgcctgacggcaaaacctgcgtccgctcccttgctcctccgctcccaccggcacccgcttgcgctgggctgccggcgggcaggggccgcctgcggcggccgttctctggagatgtcaaatctgcttcgagcactccgaatcgggtgggtgccggcggggcttacttcagccgctccgaaatcacttgggcgaccttcacgcccgacgcgcccgcctgggctaggccgcgggtcacgcccgcgccgtcgcccacggcgaagaagccgggcagggcggtctccagctcgttggacagggccagccgggcggagtagaacttgacctccgcgccgtagagcagggtgtcgtagttggcggtgccgggggccagcttgtcgagctggtagatcatctcaatgatgtcgtctagctgccgcttgggcagggccagggacaggtcgccgggcacggcggcggtgagggtggggtggacgaaggacttgctcatgcggtgctcgttggtgcggatgccgctgaccagatcgccgaagcgctgcaccagcacgccgccggccagcatgttgctgagggaggcgatgtgcttgccgtagcggtagggctcgttgaagggggaggtgaagcggttggacaccagcagggcgaagttggtgttctcgctgcgcagcttgggatcggagtaggagtggccgttgacggtgttgatgccctccacgttctcagccaccacgtggccgtaggggttcatgcagaaggtgcgcacctggtcgccgtactgcttggtacggtagaccagcttggactcgtacaccacgtcggtgatgtgctcgaacaccttggcgggcagctccacccgcacgccgatgtccacctggttgttgatgagctggatgcccagctccttgcactggttggagaaccactccgcgccggagcggccgggtccggcgatgagccaagtgcagtccacctcgtcccccttgtcggtgatgaggcggtagccctccttccccaggttctcaattttggtgacggcggtgcggaaccggaactcgacgccctggcgcacctcctcatagatgctctggagaatcttgaggttgttctcggtgcccaggtgcttgcaccgggcctggagcaggtggaggtcatactccagggccttcttctccagtgcctgggcggcgggggtctcggtggagaacacctggtcggtggccccgtgcctcatgttgatggagtccacgtagtcgatgagctccatgacctcccgcttgggcatgaagtcggtgagccagccgccgaaggcggtggtgaaattgtacttgccgtcggagaaggcgcccgccccgccgaagccgcacatggtgtcacacaccttgcagtggatgcactccttcaccttgcccgccacgatggggcaactccgggtatagatgtcggccccctgatccagggtgaccaccttgaggcccgggttgcggtgcatcagctcatagcccgcgaagatgccggcctcgccgcagccgatgatggcaacgtcatagcgtgtgttcatgtgcgatctctcactttacaacagattagggatcaggcggtgcgctccgtcccaatatggtattataacaaaggacgggccggtttacaatgcggttttcccgaaaaatcccgccggggccgtcagatccgcccccgccccgccgtcttattgatgtggccacaaacgacgaagggaggctccgggatgaccgaagcggaatttcttcccctattcgaccaataccgtcccatggtgtacggcctggccctcagctatacccgctcgcctcaggacgcggaggatgtgtgccaggaggtgtttctcaccctgctggagaagccccctgccccagggaaggagcgcccctggctggcccgggtggcggtcaaccgctgccgggatctgcttacctccccctggcgcaggcggcgggagaacgacgacacggccctggagcggctgaccttcgagacgccggaggaggccggcctgtttgccgccctgggggcgctgtcccccgacagccgggccctgctccacctgcgctattacgaggggttcacggtggccgagctggcccgccagttccgcaccaccgccccggcgctctccgcccggctctaccgggccaaacaacaactcaggaagaagctggaggaactcggctatgaagaagctctatcagaggacttttgagcaagtcctggcccagacctgcccccccctcaaccgggtggaggagcagcggcgcgccctggcctcccgctgctcccataccgaatcggaggtaactgccatgaccaccaaacccagacgccccatccgcatcctcgtcgccgccgctgccgtggccgccgccctcactgcgggcgccctggccgcctccggcgcgctgggctccatcccgctgctctccggcggagcgtttacatcaaccgacagcgtaaactggaacgaaccggacgccggagcaacggttgcaccatcccaggagaacgtgtgctttccggtaagggaggagcctgatctcctcactgtgcgcggcggcagcgtctatttcaccacagaaaccggggaggagctggacatcaccgggcaattctcggaggcggagccgtatgtctattcctataccgcctccgacggctccgcccacgacatcgtgatcggcggcagccttgaggactacggctatatggaatacgtctatgacgccggcggcagctttgtcggcagcgccggcatcctccccaccggctacgactccgccaacagccccccgtggctcaccgcctatgaggaagcccgcggcctctctttctgacgcagcggccccggcggcatgtgtgccgccggggccgcctcagcctgtcgaaaaagtcttttcgacaggctgccaaactgtttgaaacttcagaaaagtttcaaacagttattttgatccaacgcgaaagggaaccctgacggttccctttcacactatccttccctccgaaatcttcggcaggagggtttatcgataacctcaggcggccccggcggcatgtgtgccgccggggccgcctgtcacctctggggcgtatagggggccacgtcgatgccggtgtaataccacttcaaaatctcgtcgtagctcttcccctccttggccagggcgttggcgccgtactggctcatgcccacgccgtggccgtagccggtgacggagaaggtgaccccatccgccgaggcggagaccgtgaagctggtggagcgcaggccgaacagggtgcgcaggcttccaccgcccacggtggtgccgccgatgtccaccgtctccaccccgccggcggaattggggacaaggttggcaaaccagcccgccggctcgccggacagatcggcctgcgggtactgggccagcagcttgcttttgaactcgtccaggggcaccgtgacggtggagtggtagttgggcacctcgtccccctcggggctgtccacgctggtgaggtagggcaccgcgttaccccacacttccaccgcgtccaccgtccttccggcggcggaggagaagaacaccgcctggatgggctggccctggaagagggccgccatgccgtcggtatccgccacggcggcggcgatcttgtcggtgtaggtctgggcgttctccccccagttggcggcggcgtccgccgggtcgatgtaggcctggcagcaggtgatgtccgtgcacacgtcggcgtccgggtgggcctccacggtgcgctccatcttggagagggtgtaggtgcgggcggccaccgtctgggccttgagggcctccggctcaaaggaggcgggcatctccgccgccaccacccgccacaggtacttgtccagcggcagggtgagcacctccccgtcccccagggccacccgcacctgtacccggccgtccgccgtctggcctggggtgaccacggtgcggtcgatgggcagggtgccggtggcggcggggggctgggacggcccggcaagcggctcctcccccagcaggagcagcggcagcagaaacagggtgagcagcagcaccagggcggtggccaccacctgcttcattccccctccgccccctcctttttgcaagttttgtttcagcatcattcagatttcgcccgtccttgcttttttcagattgactgtttgatgaaaagagaatacaatatgggacaaatgaaaccagacagaggagctgttgcatatggaccatgcggtcagggacgcctccgccgactttattgaaagtctatgcgcggagtaccagaagcataaccagatcgacccggccttttatgagcgctaccgcgtcaagcggggcctgcgcaacgccgacggcaccggcgtcatggccggggtgacccagatcggcaacgtcatgggctattacgtccaggacggcgagcggattcccgcccccggcaagctggtgtaccgtggtatcgacgtggaggagctgatcaacggctttgtcagtgagggccgcttcggctttgaggagaccgcctacctgcttctcttcggcgccctgcccacccgggcccagctcaccgccttcgagggactgctctccgcccaccgggccctgcctcccatgttcaccgaggacatgatcctcaaggcccccagccccgatgtgatgaataagctggcccgctcggtgctggccctctattcctatgacgggcggcccgatgacatgtccctgcccaaccagctccggcaggcggtggagctcattgcccgcgtaccggtgatcgtggcccacgccttcgcggccaagcggcactactacgacaacgagtccctctacctccaccggccccaggaggggctgagcgtggcgcagaacttcctctactccgtgcgccacgacaaccggtacaccgacgaggaggcccggctgctggatctgtgcctggtgctccacgccgagcacggcggcggcaacaactccgcctttgcctgccgggtgctctcctcctccggcaccgacatctattcctccatcgcggcggcggtgggctccctgaagggtccccgccacggcggcgccaacaagaaggtcatggagatgttcggacacatcgaggccgaggtgtccgactggacggacgacgacgcggtgcgggactacctgggccgcctgctgcggaaggaggcgggagaccgctcgggcctcatctacggcatgggccacgccatctacaccctgtccgacccccgggccgtcctcctcaagcggtttgcccgcagcctggccgagaccaagggcatgctggacgagtttgagctctttgagcgggtggagcgcctcacccccgaggtgctgcgcaccgtcaagggggaggagaaggtggtgtgcgccaacgtggatctcttctccggactggtttacaagatgatgggcatacccatggagctctacacccccctgttcgccgtggcccggatggtgggctggtgcgcccaccgcatcgaggaggtctgccagcccgccaaccgcatcatccgcccggcctacaaggcggtggcccccatgcgcgcctttgtgccgctggaccagaggtgagccatgagccaggtgaccaagcgggccctggaggcctccctcaagaagctgctgctggagcggccgctggacaagatcaccgtcaccgacatcgccgaggactgcggcatcaaccgcatgaccttctactaccacttccgggacatctacgacctggtggagtgggcctgccaggaggacgcccggcggatactggatggcaagcgcacctataccacctggcaggaggggttccgccggattctggacgggctgatcgacaacaggccctttatcctcaacgtctaccgctccgtccgccgggagcaggtggagacctttctctttcaggtcacccacggcctgctcatgggcgtggtggaggagctggacccccggggagaggtgcgggaggaggacaaggcctttctggccgacttctacaagtacgcctttgtggggctggttctggactggatccgcaccggcatgaagggagagccggcggagctggcccgccgggtagagctggtggtttcgggcagctttgcccaggcgctggagcgcctgcgggcggattccgcccatcaggcgggcccgtttgatcaaaattgagacagaggggccccggtgatgaaacttccatcaccggggcccctctgctgattgcgccgccgttccggaggggctatactggccccagaatccaaagcaacgctatgaaacggaggcattttcatgtattattccagcggcaattacgaggcctttgcccgcccggtgaagccggagggcgtggagcataaatcggcctatctggtgggctccggcctggcggccctgacggcggcctgctatctggtgcgggacgggcagatgcccggccggaacatccacatcctggagaaggagcccatcgccggcggcgcctgcgacggctggcactacgagggactgggctatgtcatgcggggcggccgggagatggacaaccacttcgaggtcatgtgggatctgttccgctccatcccgtccatcgagaccgagggcgtgtccgtcctggacgagtactactggctcaacaagcgggatcccaactactccctcatgcgggccacggtcaaccggggggaggacgcccacaccgacggcaagttcggcctgagcgatcagggcgccatggagatcatgaagctgttcttcacccccgacgaggccctgtacgacaagcgcatcacggacgtgttcagcagtgcggtgctggagtccaacttctggctctactggcgcaccatgttcgcctttgagaactggcactccgccctggagatgaagctctacctcaagcgcttcatccaccacgtggggggcctgcccgacttcaccgccctgcgcttcacccgctacaaccagtatgagtccatgatcctgcccatgctcaagtacctggaggagcatggcgtccagttccacttcaacaccagggtggtggacgtggagttcgacctccggcccggccgcaagcaggccagccgcctggtgctgctgcgggacggggcagaggagcacattgatctgacggaaaacgacctggttttcctcactcccggcggctgcgtggagaattccgcccttggttcccaggattcccctgcccccttccggccggagctgaagcccggcggcggctgggacatgtggcggcgcatcgccgcgcgggaccccgccttcggccggccggacaagttctgctcccagccggagttgagcaactggatgagcgccaccgtcaccacccttgacgacaaaattcccccctatgtccagcgcatctgccagcgggaccccttctccgggaaggtggtcaccggcggcatcgtcaccgccagggactccaactggctgctgagctggaccttcaaccgccagccccagttccgcgaccagcccagggggcagctcgttgggtggatctacggcctgttcagcgataagccgggcaactttgtgaaaaagcccatgcgggagtgcaccgggcgggagatctgcatggagtggctctaccacatgggggtgcccgaggaggagattgcggagctggccgcccacagcgccaataccgtcccctgcatgatgccctacatcaccgccttcttcctgccccgtgccgccggggaccggccccgcgtcgtccccgacggggcggtgaacttcgccttcctggggcagttcgccgagacggagcgggacaccatctttaccaccgagtactccatgcgcaccggtatggaggcggtctacaccctgctggacatcgaccggggcgtgcccgaggtgtggggctccacctacgacgtgcgggatctgatcaacgcctccgtccagctgcgggacggccgcaagctcaccgagctggagctgaacccggccgagcgccttgccctcaaggcggtactcaaaaagctccatggcaccgacctggagaggctgctccaggactaccacgccatctgaccagaccggccccggcgctttcgaaaagcgccggggccggtgcccgtcaaaaaggtctgttgaacgcttccggccggttcaaacggctctttatcgacggaacagccagtacaggagctgctccgacagggtcatgcccacctttttctggagggccagggagggggcgttgtcgataagcacctggccaaaggcatactgcccccgctccagcgccagccgcaccgccccccggagcagcgcttcccccaggccccggcggcggtaggcgggcagcacctccagaaggccgatggagccctcgccgtggaagcccgcgaagcccgccagcgtcccgtccacgaaggcccccagcataccggcgccgatggcctgccggatgtgctccaggccgccgatatcgctcttgctgtagtgctcacagacgtagggggcccactcctcccccaaaaggcgcagctccccgccgaaggccggcgcctccggcggctccggagccgtccaggcggcctggacgcacagctcctccttccacaggccgaagcggccggccagctcgtcccggtaccagaggtcgtggcccaccagcaggtcacagtccgcaggcagcagggggagcatcccatccagggcggcccggtcccgggcggtaagcatgtaggcccccgacccccggtcatagagcagcaccccgccctccccggcgtagagcagctccgccgagccccgtcgcagcacctccagcatgtttaagtagagcagcctatttcggttcagacaggccagcgcggtttcgtttaaagacatggcgcacctccttataaagcggcagagagatgacgaagctggtaagccgcccgttgctctcgcagcggatgttccctccgtggctctccacgatctccttggcgatggccagccccagcccggccccgccggtgcgggaggagcgggcggcgtccagccggtagaacttctggaagatgttggccagctccccctcggggatctccagcccctcgtttcggatggtgatctccgcctgacgccctacggttttggcctgaatgtccacccggccgccgggggtagagtagctgacggcgttgcgcagcacgttatcgaagacccgggcaagtttgtccgggtctcccagcaccactaggtggtgctgaatttccaccgtgcactggagctgcttctccgcaaagagggggtagaactcgtcggcgagctgctccagcagcatggacagctggatgggctggcgctcccccggcccgctgtccagatccatccgggtgatgtcgaaaaactcccccagcagctcctccagcctccgggccttgtccagggcgatgccggtgaacttggcccgctgggcggcgtccaggccggggtcgtcccgcagcagggtgaggtagcccaccaccgaggtcagcggggtcttgagatcgtgggccaggaaggccaccagatcccccttgcgctgctcgctctccctggccgccgcctcccgcgcccggagctgccgctggatggcgttcagatcctcctggatgggggccagctcccggggcagctccaccggctccgcctgggcctccaccagccggcgggtggccgagcggatgtcgtccagccagcgggtaaaccggcccatggccaggtagaaggcgatgagcatcagcagcatggtacccagggtgaggatctcctgcttgttgttgcggatatagcgctggtagagctccgccgccccctccgggctctggccgaacagggtggtggccgcccagaggaaaaagcgggcgaaggggtcctggagcaccccatccaccaccacctccagcagaaagatgcccacgccccccgcgatcagggtgcccagcaccacaagcagcagcattttcagcttgaggcgggtatattttccatccaagacgttctcctcctatgtcccgtgtccggccgccgagcgctgcgcaaagcggagcaccgaccaggccccgcccagcagcagaacctccagaaaggcggcaaagcgccacagcaccagccccaccgccagatgccggccgaacagggggcccatgaacaggtagaagctcccctccgcgccgccggcgttgcctgggagcatgatgatgcgggagagcaccagcaccaggcactggaccagcaccagctcccagaaagagccccctgtcagacccagcccccggtagaggaagaagggaatggcaaacagggccgtgagctccacaaacatgcccgcgaacaggcccgccagcatccggcggttgcccttgagggtgcggagctgtgcgcagaactcgtccaccttttccatgcccttgtccaccatgccctccctggccatcaccttccagtggcgggcgaggaaggtgaggatgcggcggatcagacgctgaataggctccggccgcacggcggtaaagagggccagcccgcacagaaacacgtagagggcaatcagcgcccccgcccccgccacggcggggcccagcccctcccgccgccagaacagctcataggccagggcggccactgcatagccggtgtaaaccatggtgttggccactgccttccaggtgtagatggaggcggtgtaggtggcgctcatgcccgcatcgtacatcagcttgagctgcaccggcgcgccggcggggcccagcttgtagtaaaactccccaatataggccgcatcaaagcagcccgccaacttgacgggacagcccgccgagcggcccataccgtaaaagatcagcgcgtccacgctttcgctgagggggacgcacagggctgcccccagcagccacaggggctggatggaggccagcagggcccgcacatccatagtacgggccacatacacgatgagccccgccagaatcgcgccgccgatggacaggccggcgatggagaaaatacgattgaacagggccttcttatttttcttttccgttgggaacaccttctccagacaggttcagttgctgcgacgcagcacgccaccgcaccggcagcggtaccgctccgggtgatccaccagcggggagcggcggctccggcaaaactcctgcccgcagcgttcgcacaccagccggtagcgcaccggccgcacatccgccacccccagcgcctcacaggtgccggtacgggagatggcatagccgtaggccccattcatccgcgcggcgtactccttccagagggccccatggttgcggcagccggggcaggtgtggagcacttcgtgggccagggtctgcatacacgcccgctcctccgcctccagcagccgctccgacagctcaatcacatactccccgccccgccggatgcagcagccgaaccgggtcactgcccggcggttgaccgccacgcggggggagatgcgggccgacaccgggatgccgagggctctggcctgctccaccgcccgggccagcagggcgtcaaactcattcataggatgcctccatttttactaaaaatgattgtaccaccctttttcagaaaagtcactagccgcctttggcggcggggtgggtcacagcatagaatggcccgggaggtaattgtcatgaaatactgttttgacccctgcggctgtccgccgccctgccccccatatccgccctgtccgccctccccgtccgggcccacaggccccaccgggccaaccgggccgcagggggagcggggaccgacgggcccccagggcgccgccggagcgcagggacccaccgggccctctggaaccacggggccgcagggccctgccggaggccaaggtccccagggtgtgcctgggcctaccggccctcagggtatccggggcatggacggccccaccgggccgcaggggcttcccggcccagccggagccaccgggccacaggggccccagggcgccgccggaccaacaggcccgcagggggcggcaggggccaccgggcccaccggccctcagggcatccggggcatggacggccccaccgggccgcagggacttcccggcccagccggagccaccgggccacaggggccccagggcgcgaccggaccgacaggcccgcagggacttcccggcccagccggagccaccgggccacaggggccccagggcgccgccggaccgacaggcccgcaagggacacccggcgccactggccccactggtcctgcgggtggaccgggtgaggatgtctttgcttcctactactccgatgtacgatccgtccccaacaacggacagattccgctctatgagctgctgaatgaccccacaggcaatatcacactgagcggcacccagcagcttcggctccagccgggctactaccgggtctcctactccgtgtcagccatactggaggccccgggctatcttcagatcacgcccgccttcggcggcctggcgcgcattgacctcggcatctatttccgcacctccggaaacagctccaccgccaacggcgcccgcaccttcacgttttacacctccgaggccaccaacttttccctcacctacagcagcgatgtgtccggccggagcgtacagactacgctggacatagagaaactcaaccgcgtctctggctgaaccagccccggccgggggcacgtctcctggccgggccagttctgatgtttttcttacaattacgccccacccttgacttgccgccgccgctttggctataatgtcctggaaaagggggcggatgccatggacgcgcggattctggttgtggacgacgagccggagattgccgatctggtagaggtctatttgaagagcgaggggtgcaccgtgttcaagtgcggtaccggcaccgaggcgctggccgtggtgcggaaccaggctctggacctggccatcctggacgtgatgctccccgacatcagcggctttaccctctgcggggaaatccgcaaggagcaccacttccctgtactcatgctcaccgccaaggcggaggacatggacaagatcaccggcctcaccatcggcgcggacgactacattaccaagcccttcaacccgctggagctgatggcccgggtcaaagcccagctgcgccgctacacccgctacaacgaggctgacaaggccggcgactgccgggacatcattgacttcaacggcctggtcatcaaccgggccacccacgagtgtaccctctacgaccgggagctgggcctcacccccattgagtttgacattctctggatgctctgtgagaaccggggccaggtcatctccgccgagcggctctttgagagcgtgtggggggagaaatacctggaccgcaataatacggttatggttcatatccgccgcttgcgggaaaaaatgggcgagccctcccgcaatccccggttcatcaagaccgtctggggcgtcggctacaaaatcgactaatttttttcaaaaaaacaattgacaaaacgggaatgatcgcgtatactgaatcctgccctgtccgacagggggttttcaatggcggcatagctcagttggctagagcatgcggttcatacccgcagtgtccccggttcaaatccaggtgccgctaccagaccccaaaagacggcaccgcgccgtcttttgggacttcccttcaggagtatcccgccccgcttgggcaacctggcccgttggtcaagtggttaagacaccgccctttcacggcggtaacacgggttcgagtcccgtacgggtcaccaatatatggaggcgtagctcagccggtagagcacttgcttcacacgcaaggggtcacagattcgagttctgtcgtctccaccagaaaaggacatccgtaaggatgtcctttttgctttgatctttaccgcccggagggcggctcccctttccgcattttcatgctggggacggcgcggcccgcaaaggcccggacatgcttcaagttggttcatcgagactttgcaatatctgaattgcattgaattttcagaacgctggcatccagatgaatgcccgtttctgctgcccaaggcggagaaccacaacacgcggggcgggccgaaaaggcccgccccgcgtgtctcacactgccgtctcccgctccagcgcccgcacctgcggaaccgccaggagctttgcaaacaggatgccgatgatgccgccgcagatctgccccacaaacacgggaaccagcagattgggctggaaattgacgttgaaggccaggaagtcccccaggctgtatccgccgcaggccaggaaggccatacacaccaccttgtcccgggggcgcatctcctttacaaaggggaacatcgccaggccgttgggcaggcaggccaccaggcccacgctcccgctggcctccagcccggccagacggcccagcttttccaggggcttgcccaaataccggcggatcagcgtcaccatggggaaggcgccggtgagcatcatggcgatggtgcccagcagctccacggcccggaaggtgttctcctcgtcggccagtatgggatcaaagccccagccgacgcccagaatgtcggtaaacaggccggtgtagtgctggaggatgcaggccaccaccaccagggtgagggcgccggtcatcagctttccaaacaccatgaagcccttgaccatcccgttgggaaagaacttcagccccagggccagcagcacgcagatgaccaccagggggatcatgttgcgcaggagcatccccagggtcagcatcaccacatgatccggctcgcccacactggagaaggtggaacggatggccgggtgggtaaacatcacgatgacgctggtgatgaacacgccgaagggcacggagaggaagccgctcatggtgcccagggccaggtatttgtgatcccccttgtccagcatggacaggccgatggggacgttgaaggcgatggtagaggcgcacatgaagccgatggcgatgatcaccgggaacagatccgcgctctggccgatctcggtggccagggcgaaggaaccgcagtccggcggcatgatgatcgcggcggctaccaccggatctccgccaaagagggcgaataccggcccgaacaccttggagatgaagactttcaggaagggaaccgaggccatcagcccgcaaatggggatgaacatgttcgccatggcgtgcaggccgtcctgaaaggcccggcccagctccgactggtcattgacaatgtaggagattccgccgacgacacagcaggccatcatgagataggtaatgagcgttccgatgaattccatgggctgcccctcctgcccgtcagccgcccagcagggtcaggctgcgggaaaagctggggtcgtccaggaaggagcatgcctgaaccgcacgggtgcggccgtactcccagtagaagtccgcgtccttgccgtagcagatctgaaccagcgaccaggtagaccagtgggaggtcaccaggaacttgttgatcagcaggcgggccttggcctcctcgctgggttcgccgccgcagtaggcgcggaagaacacatcctcgcagcgggcgtccagggggttctccacacagacgcaggcgatatcgtagtagccgtcgttcatgccgccgtactcccagtcgatgacccgcatctgctcgccctggagcatgaagttctccgccagcgcgtcgttgtggcagggcacccggcggggcggctgcttggcgtaggcggcgcggatgcactccagcgcctccaccatgcgctcccagccctcgtagcgcttcccgtagttgtgctcgtccaggatggccttgtactcgtcaatcttggcgacgggatcaaaggaggtcttgaactccaggccgctgtcgtgatagcggcgcatgaccgctcccgccttgaccagtacctcgtcccgggtctgaaagtccacggggtgcatggtgggcgcatcaatgtactcaacaatttgtgaacccgtcttgggatcgtagtaatagatctccggcgcaatgcccagtccggcgatctcaccggcattgtgcttttcaccagggcggttgatatagttggcggtaccctgtccggccaggcggatggcaatctgggtgccgtcttcggtcacggcccggaaattcttattggtcaggccgcccggcatgatctccaccaccgtcagctcctgcttgaagatttcgcgcgccagattcagaaggcgcatgaaatcggcaatctcttcgttgcggatcacggtgccaaaaacggacatattattttcctgcataataaagccctccgtttgttctctgttttaacaaagtggaattgccgcagtgaggcgctgagtctgaggaaaaagtgcggccagggggggccgctctttccgtctgtaacgagcatatacctttgtgttacacaaaagtcaatgcatctttctctctcgtgcagcattttgttttattctcacagtaattatttgctatttttatttaatttcactaatataagagccttttgacaggtccggccgcctgtgatagaatgtcttatccgcgcagggggtgagtcccatcaaggaaaatctgttgtccatcacagagcttgcgaagctgcggcaagtgaccagcgaaacgcttcggtactatgaccgtattggactgatcacaccggactatgtagatccccaaacccgctaccgctactattccatccgccaatacgaaaaactcggcaccatcaaggaactgcggcagcttggcatgtccatccacgacatcaccgactatttttcgggccgcaatttgaggaaatcccaccagcttctcctccatcagttggagctgctggaggaggagatccgcaaacagcagcttctcagcgaaattctgcgccgcaagctccactttctgagtgagatcaccccgcccccgccggtggacaaggtcttctgccgcgcctttccccagcggtatatgattaccttcggagagcctgccggcggctcccgggagcacgcctttgccttcacccggctggagcgctacctggacgaggtggcccccatcctggccagcgaccgtatcggcgtctacgcggactggcacctgctggagcccagcgacgattatattcccgccgtccccatgatctttgtggagcgtgacgccattgagtccgagcataagcgcacgatacccccgggggattacctgtgtatgaattaccgcagaggcgagctggagcgataccacccctcctttgcccgcctgcatacatatatggcggagcatggctgggtcctgaatggaatgatttttcagttctacaaaattgacgtcaccctcaccagcgatcccgacgagacgctgatggagatccaggtaccggtgcggccggcggagtcttagcggctccgccgtcgtctttctgctctgcgcaaaatccatccgggcccggccgaaaaatcggccgggcccggatggattttgcgcgaaaagagaatatagagagttgaggtggagtgcaaaaaattagaagacaatgccgtttttctttttataggccacgtgggagatgaactcctgcatgaggcccgccgcggcaatggaggtaatgccggtgggatcatacgggggagagacctccaccacatcatagcccacgatattcagatctgccagaccgcgcaccagctccagggcctgggcggtggtgaagccgccgggtacgggcgtaccggttcccggcgcataggcgggatccaggaagtcgatgtcgaaggtcaggaaggccttggcgctgcccacccgcgcgcggatggccttcagaacagcctccatgcccatcttgtggcactcgtcggcgcgcagcacctggtagcccagatcggtggagttggtcagatcctccgggccgtacagcccctcgcggatgcccacctggatggatttggaggtgtccaccagcccctccttcgccgcgtgatagaagggggtgccgtggttgtacggcttgccgaagtactcgtgaatggtgtcgtagtgggcgtcaaagtgaatcagcgccacagggccgtttaccttggcgcaggcccgcagctcgggcagggtgacgctgtggtcgccgcccatggccaccggcacaatccccttctcaaagaagggcagcattccctctgtgatgagctcaaaggactcctcgatatagccgggcacagaccccagatcgccgtaatccacaccggagcaccagtcaaaaatacccacattcagcgggccgttaaagggcttggccgccagggcggaggcgtcgcggatcgcggcaggccccaggcgcgtgcccacccggaaggaggcgcaggtgtcgtaggggatgccgaccacggcaaagtcgatgtcgtcggtggtgaccacgtgctccatgcgcatgaaggtctttacaccggcaaaccggggagacttcaaggaattctttgctttgtacttaatcatagccctttgctccttcttcaattaagatcgtgcgaggcccgccgggagcgccctccgcgcggaaactggactgcggcacccgttccgctcggtggggcgctcctgcggccctcttccccctgtatgccccattctatacccttgtgttacacaaaagtcaacccctgtttttctttcttataaaaaagcgtctgagacggcagtagggcggcggaagttccgccgccctactgccgtttaatagagctcagtatagattttcagcacccgcgccgcatccagagggacgaagttgttgcccatcagccggccctgggtctccatcacgctcctggtgaactcctccagatccgcctccgtcaccccgtaggcgtgcagcggcttcttgggcagaatctggttcaggagatcctccagccggtcatatacctccggaaccccgcagcccagcagctccgccagatagcggttcatcaccgcaagctcgccgtcctgcttaatctccatgtagttcttcaacacaccggtaaacatcgcgtagttgctctccccgtggggcacgtggtattttccccccagcgggtagctcatggcgtgcaccgccgcgcacccagccgtaccgaatgcaaagcccgcatagttcgacgcaatcaggaagtcctccagcaggggcaggcgggcctcccgcccctcccgggcgatcgtctgatatccccggatgagcatctcaatggccttatacccgaacagcttggtatacggcgtcgccttcggcgacaggctggactccaccgcgtgcaccagcgcgtcgatcgagctcgtcgcaaataccccgaagggcagcccctccaggagctgcgggatgagcaccgccgcgtctgcatacatggccggccccaccagccccatcttcgtccccaggcgggtccggttcagaattgagatgttggtcacctcgctgcccgtgccgcaggtggtggggatgaggaccagctcccgccgcttgggcagctccggcgccatgccgtacagctcgtcaatgctctccccgccgcccaccgccagcaccttggcgatgtcgatgaccgtgccgccgccgatggccacaacccggttgcagcccgtggcggccgcatcacgcaggatggcctccgccatcacgtcggtgggctcacccatgccgtactgctcctggtacagcacggcacactccaggttcatcgccctgaagtagggctggtagatgtactcgttggtcaggatcaggtcggacgcacccagccggaattcctccacgaactccttgcagctcgaaaagcggtgcagctccggcttccatatgatttctttcatggcatatttccccttttcatatccagctgcctttactttcgctttttctgctccgcgctctcccggatataggccacagcctttggatcatccgtaaacttacatgcttccgtttccgctgtggtgatgtcgatgaccactggcccttccagctccagtgccgtcttcagctcttcccgaagggtcctggggtcccgaatggatatgcctttacaattgagccccctagctaccgcggcgtagtcgatggtttcggtgtccacctcggtaaagcggccgtcccacatggccgcctcgtaccacttaatccaacccaggatgctgttgttgagaaccaccaccttgacatccatgttttgctcatggagcactgccatttctcctaagcagtagttcagccctccgtcaccggtgagcaccaccaccttgttccccggccgcgccgccgctgcgccgatgccggcaggaagtccatagcccaggccgccggcgccccggggaagaatggtacgacgggcaccatatacgtcaaagaagctgcccgcccagccgcaggagaaactggcgtcgcaggccaggattgtatcgtcgccgcacaattcattcaataaggagacgaccctctgcggagtaatacaatcatcagcctccaccgccggccggtttttttcccgccaagcgcggtacaacttcgcgatttctttttctacagcagtgggatctctctgcgcatccagccgatccagcagaagctgcagggtggccttggcatcgcctaccagccctacatctgtagtatgcagtttattcatttcagtctcgtcaatgtcaatgcggatctccttctggcccttcctgggaattgtccagccataggtggagttttgactgaacttaaagccgatggcgagaatcacgtcggcctcctccaccatttttctggagacatcattgccgcccagacttcctaccacacccagggacagtgggtggttctcaggcagcacaccttttccggtcagggaggcggctgcgggcatagccatgcgctctgccagcgccgtgatctccgctctggcgccggaacgccaagcaccgccgcccagcagcataaccggcctcttggcctccttcagtacctggatcgcctcgtcgatttcgtcgcgggacggggtaggacggtgggcgggcaggctggccagttttcggttgctctcatagtccggcccggtatattcctcccggaagggccgccatggacactcgataaatacgggtccgggacggccactgaccgccatctgggcggcagtctgcaccaactccggcattttgttcacatggggcaggcacgcctgccacttggtcactggcttgagcacctccttggagtctaccacttgggagcccgtaccgcggtaccgggcggccagccaatccccctccatctcagaaccgatggcgatgacggggatggaggtgttgtacgcctccgccaagcccgaaataaacttgatggcaccgcagccggcggtggcgtcgcatactccgataccgccgctgatacgggcgtaggcgtccgcggcaaaggtggcatcaatctcatccttcatgagaatatgcctgatacggttcccctcatccaaaattccgtagtagagcggcaaagtctgcccgccgggcacaccaaataccgccgtcacaccatagtcggccagcaggccggccattacatttcctccatgctttttcatccgcttgtccatacctttctgatttagacttagtaaatggttctatcagacacgtttgcctgcggcaattgcagccttcatctcttttctggcctctttataaagctggtagctgtcggagcgctcaccggacctggtagtgaccagcgtgacaatgatctgggtcgccagtgcgacaataccgccggcataggtaatctgaataccgaatggactcgtaccgaagacgtagccgtagacgatccagacaacacatacgatgatacccaacaccatgctgtagaaaatggacttctcgttaggccgcttccagagcagaaacagggtaaaggtcaaaccgcataccgcgcgcactgtcagcgcgttggacaggatgtccaccacatcgctggagagcaggccgagcaactggaacaggattccgaataccacaatgagcagcttggtcagaaacattttctgcttctcactcatagggctcttacgcaggggagtatagagctccattgcagtactggacattaccatgatgtaggtcggcgccgtagacatactggccgccagcacgccgcaactggccagcgccgccatggcgggaccgtaatgaccggcaatggtgtaccaggcagtccccggatccatgtcgggccacaggaacttgccacagcaggcagctatgatgaccaatccaaaaaagaaaattgcaaaaataggcatgatggattgagccttctgtgcggtcttggcgtccttggcgccgatcgccgcagagatggacaatgcatttacaaccgtaacaaagggctgaatggcaagcgtaccgatgatgtaggaattgcttctggagcctccaatgagcttaaaggtaccctggggctccagcgcacggtaaacttgtccgaagtcccatcccacagaggtcattaccgcaataaaaattgccacaacggacacgctaagtacaaccacatgcaccatattgatgcgggccagacccttcatgccgccctgaagtgccagcaggatcatggccgcaatggtgacggtcatggtaacctcgctgcggatgcccagcagggactgaagcagattggagacgatgaccgtctgtgcgctgaccgcactggcaaaagatacgaagatcatgactgacacacagacggatacccgcttgctgaacagcttttcaaagatttcccccaaggaggaacagccatatttatagcagatggagcgataaatggggatataggcacaggtcagcgcccagccgatgatatagccgtagaaggtccactgataggcgatatcatgctcaataactgcagatgagttgccaataatgtagctggaactgatcaggttgccgcacatcagcgagaaagccataaacaaccccatgctgtttttaccggtagagtactccactgcggtttcattcagttttctttttttggttctgtagtccagaaaaaaggccatgcccacgcaaaacaggaagtaccctaccaccagtatgattgtcaacatgttttccacctcacaaaaacgtcttttgctctcttttccattgctctgccgcctgttttagcctccttttcttttattctccttcgctttatgcgatataaccacccagcacatccacgcaggagccggatacatagctggcctgctctgatgccagaaatgcaattacggaggctacttctgacggctctccaatacgccccagaggtatctgactgcagatttcgttctggactttctgcggcagcaccctcgtaagttccgtattaatgcggccgggcgatacgcagtttacagtgatattgtacggccccagtgtctttgccaaacttagagtcatcccaacgattcccgccttggtagcggcgtagtgcgctccggacttatttgccccaaaacgtcccgccattgaggccagactgataatgcgtccccagcgtttttctttcatctgcgccgcagcctcctgtgcacagagaaatgcccccattaggtttacccgcagaacctgttcaagctgctccagcgggatatcttcaaatggaactttgggggagatcgctgcattattaattaaaatatccacgcttcccaaccgctctgcagccgtccgaaagaggtgcttgatctcctccggcacccccacatccgcatgaatatagattccagttccccccctctcacagatttcctccactgtttcttttccgcggctgtcattgatgtcacttacacagaccacggcaccctcctgggctaagaccagagcagtttcccggccgataccctgaccagccccagtaactaccgctctctttcccttgattcccaactccattttctgcctttcctttcctcatactttgttgcctattaacctgctgtacgctggcagctctccgaggtccctcagacgctattatcaaaagcaattttaattccatatcgctgcaaatgaatcctttttaaacttttttattttttagcgaaaatactttgcagatatttggagtaatctcacaaatttgttttatccttttcttctcatacatctgtttgtatctcatatctggatatcttaaatcattttaataatgtccaaattgcattgacgggccatgctctgtctgttatccttttaagaggcaatgtttcacccatgcgcttcaaggagggacaccctatggccaaacaaactcttggtgtttttacggaaaacgagctggaccgtaactatatgtgtaaaattctctcacaggttttttcctcgtctctggatattgtccctgttacccttgccaccgtacacacgcttgcggcagaacccgccgctattttggtcaatattacctcccttgcgtacgccgacaaatattttccaaacagccaaatcatatttgcccggcgttttttggacagcaatcacttacatcggcttttggaactgcccgaaggtacgccagtgctggttgcaaacaagcccagacggattgcggaggatttggtagaaaacctgcaacagctcgggatcaatcatctgaactatatcccttattggcccggctgtgacatagacactactccctatgacaccgttgtttatgccggttttcgcagctattgtccagaaaacaaaaaggtctacatcaacctgggataccgaaatatcactccctctactcttgctgaaattgtcaaaatatataatctgccgcctgactttttgaaccagttccatataccggtgatgcagcaactggtatctgagctgtaccaccgacaagatatccacacccagaaccaactactcaaaagctagttatcccagacactcgctcttacaggcactgctctgttccacctggatgagaaccaacagatcgtggagctgaacgaggccgccgcccgtctcctgcccgccggacagaagggattgcctggccacccgcttctcccgtgttttccagagttggcccacctcgccgcctccctgtccgaaggtcgtgaggaaaaggaagtcgtatatttagggaaaaagccctatacactgcacctccacttcgagtcccccctccagcaccgccactgtttcatcctgcttaccccaatcgccgcgtcctcctccgaaaaacggtgctctcatggtgtaaaaaagaactccttgccagccaagtaccacttttcagacattttaggacactcccccgctgttcaaaaggcaattcgcctggcacagtactattctggtacagatgagaccatcctcatctttggggagagcggcacaggcaaggagttgtttgcccagtccatccacaatgcctcgcgtcgccgtcaaagcccctttgtggccgtaaactgtgccgccattccagataccctaattgaaagcgaactttttggttatgaagagggggcttttactggggcacgcaaagggggaaagcagggcctctttcaaaccgccgataacggcaccatttttcttgatgaaattggcgacattcccctctctcttcaaagtcgccttctacgggttctggaagagcgggaagtgatgccggttggctccaccagtgtgatccctattgacgtacgggttatctgcgcaaccaaccggaatttgaacgatatggtccggcagggtaccttccgtgaggatctctattatcgactcaagatcctgcccctagttatccctccgctccgcgaacgcgtggaggatatcccggaacttctccattccatggccgagggtgcgcgacttccagcacaattagagcacagacttttacattatacatggcccgggaacgtccgcgagctgcgggctttttctagtaacctgactattttttatcagcaggatattgcccctgatcagcagcaatcgcttttaaatgatttaattcgcaacttttttggccaccgaatttctgcgttcaccgactgttctgaaccactgtcccaggaagaccgcctcattttgaactccattcaggagcttaccgccgccgggcgccctgcaggccgcggttccctgcttcgcctttcgcctttgttggcggcgggttttaccgaggccaagctgaaattaagaattcgccgactggcggagtccggctacatatcagtagggaaaacccggcagggactccgccttaccctattgggcaccgaagcactcgcacagggtgaagtatagcaggcctctccggtccactgtaaaaaccgtctgtctcaacggcaggaaaaagcctgtagtcgtttgactacaggctttttccttttattcttttttttccccttgggtcagtttatctccggtactgtccacgccggactccagcgctgcaatagccttggacagccatgcaggcaaaggggctcccagccgcccggcattttctacgatactccccagctcggtcaggatataccagaccagcaccagcaccgtgagaaataccgtataatcgaagggcagggtcagggcggggatatgatccaggatcaagcccagcaccccgtccaggatggcggccaccaggacggcggccatggctcccaccttgtgccagaggccctcccgggccgccttgcaggaccacttccccgccttgagggcggcggcggtgccggtggcgtagtccagcagcatacaggccacccacgccaccaccagccagccgaaccatccccacagggcggtcaggcagcccaggacagcggccacggcggccttgaagccgttgatgtggtccatcaggccccgcccccgtccagcaggcccaggttgcggagcatctgaaggttaaccaggttgtcgtcggtcaggcggagtccgccgccctggtctccccgcagcactccctcgtcaacggccttctgcaccgtctccctggcccacgcggggcagttctccacactggtgtagaccggcggccgggcggccgtcacggccgcgtcgatcatggcctgaatttcctctttcgtcatgtcggtgtcctcctctcgatatgggggcatggcgggcgggtagtcccccgcccggatcatactgctggtgtattttccgccgtcgctccactggagatggggccggtcagggaagctcttccaccggccgccccactcaaagcccacctgttcccccagctctccggcccgctgaaagaatgtggaatccgaatactcctgtcccttgatgttctggcagaagtcgaaggccagccccgcctgctccccgtgaaagctgggtacaggcgtggcggccgtaccgttttcatagcagtattgctggtactcctcatcccgcacggttccggtgaccagcaccagaagccccgccgcgcggcacagctccagccaggcgcggcagttggccgccacgtcggggcgcagccggtcaatatcccggctgttcagcattgccgttccctccgttcgctcgctccatggctctcatcctttctcctgtggttcaaaagggggcggcaaatccgcccccttcatcttatgcctgcacttcctcccactgccacatgccgggcgtgtcggggggccaggtgcaggggatcatgtccccgccctcggccacccggtagaccttgccgttgtagcggtagcacttgcccgcatagcagtccatgccgtacacccaggggatggggtcgtccgccgtgccggcgtgctcccggtcgatgggccggtagacggccagcatcccctcgtcgtggggggcttggtgggcctggggtgtcaccgcctgcaccacccggtagagctggccgccgtcgttgaggacccgcccctcaggcagctcctcgccgtctgccagtaccgccgcccaggtgggaaacagatcggacatgtccagggcatagctgtccgggatggctgtgctggtggccgcataggacagcatggctgtgcggaactggggcgtcaggtccggctccggctccggcttgggcggctgctcccggggcgtcaggcccaccagcttgccgtcctgtatgtccaggtcgcagtagcccgcacagtcccaggccgtctgctccagctccggcggcacggcaatccacccttccagccagcactccgtccggtggctctggctctgcaggccgtggccgccgtcctccctggccttaatctcgatgatggtcagcatgcaattccctcctgatccattcaaacagtttgagcagcaggcggcccagactctgccgcctgccctccctctctctgccccggccgggcaggtgctccacccacccctccagggcggccagcagcttcccgctcccccagcggccgccctccgtccggcgcaggccctcccccagctccgccgtgcgggtctccccgccccgcaccagccgcagcaccatggcacgcaggggcggccgctccgccggaggccgccggggattgggggccctggccggggccttgtgccgggggcgcagcgcctcctccgggggctccaactggttgaagtgggccatcagccgctcctccagctcctccagaccccgcacctccgccctagttcccaccgccagcgttcccagccgctccagcccgcaccggatggagcgcagtaccgaggcgtggtccacccgcagcagccttccgatctcctgcaggctcagccactccccgtagtacaggtagaggtagagctgctgccgcggcgtcagcagggagagcaccgcctccagcacccggccgtccgccagatccaccaccagcggtcccggcccctgttgggcctggagcacctcatacagcgcctttgcctccttggcaatctttgtacggccccggcccacggtgcggctcactgtcccccggtggcgccccgcctcccgggccacctgggcggcctttttccctccctctacctgggccagatactccccctgcttgtccgtcaccgcccgctcccgggccagccggacggccaggcgcatgcggtccagctccgtggggccgtcctgctccccggcgccctccagctcggcccaggtctgatactgaaacctgtcccactgccatccgtccacccccgcccaagtggtgcggcagcgtaccttgtggcttggcatcagctccttcagccgccgggcgcagtccaccagctcctcctttacccgggccagctccagccgcagggggcgcgcacccggccccgcagcccccgccagggccttctccagctcctcccggcgctcccgcagcgccttggcccgggcacgcacctcctgggcctcagtcatcctccacaccccctcactgcttcgtgctgtccacccggggcgcgtagatctgggacatgctgtaggtcccgtcccggggcctggtataatacccctcggccagttggcgcaaatcccgcatctccttcagcatctgccggagcagcttggccctcccctccagcgcccgccgccgaccgtcctcggcggtctccaactccgccctgacctcctccaaccccatccgcagccgcaccgccgcgtccatgtagccgtctgccagctctgccagtctggccacgcctgtccccccctctctatgcggcatcctacatccgcttcgccggctctgccaccgcctccccggatcggaccccccgtccctgggtgggatcggcggttttgagggacactcccgtacaccgggacaaaaaaatcagcctcccggctgaatcggaggctgatcaaagcatattttaccggaacagggccggcccaatgggccggccctgttccggtgtgtgtgtaaacagagaggtaagagagatgagaggaggttgatgtcacttcttcctgacgctgttgatcttacgccgatttttccctggattggtgaacggactatgaacgatccataaaggtatccttaagaatatgatcttccacagaagaaagcgccaaaaagaagacacatgtcctttttttagaggcagtggcttgttataatgggggcagaattggaacgggaggtgcggccctatgaccatacgggagctgcttgcggaggagtctcccacgctgcgccggcggctggcatcccttttttccggcctgccggatgaaacaccggccagtccgctctcctgcgccgccggagaggtggtggtgcggcaggacgccccctgccgctgcgtctatgtgctggtggagggccgggccgacgcctccgggctccagcccggaggcccctcccacacctactccgagttcggccccctcaccctcttcggggagtacgaggccctgtgcggggcaaattgctttctggccgaggtgcgtgccagaaccgcctgccggttttgggtgctcgcccgggaggactacttctcctggttcttctccggccgggacaccaccctctcccgggtacgggaggtggtgcgcagcctgtgggagcaggcccgccgggagcggggttacctgtctctggacagcgacagccgccttctctccttcctggtctcctggtatgaggccaacgccggaggcgggacggcctgcatccccatgactcgcccggccatcggtgacgagaccggggtgtgctcccgcacggtcaaccgcggggtgcgcgccctccgggagcggggattcctcgacatccagagcggaaaaattcagctcagccatccccaatacctccggctccgcgcggagctggagcggcgcctggccgacggccgggccatacactgatggagggattttcatgtttcattccgacagcgcctttgccaccctgacctcgcagacccttacccacgagcagaagctgatgaacctggccaaggaggcggaaaatgccttcgacgtgctggacatcccgccccgcacccgccatttctttgagaccggcgccatcaacgacctctttgaggggcacgccccctaccgcccccggtacatcctgcccgactacggagcgtttgtccgccagggcagcgccttcctccgcctgccgccgcctcaggatctggacgagctgctcttttccctgatgacgctctaccgccatgtgccgtccatcaccaacttcccggtgtacctgggcaatctggacaccctcatcgaccccttcctggacggctggagcgacgaggaggcgcgcaggaagctgcgcctcttcctcaactatctggaccgcaccatcaccgactccttctgccatgccaacctgggcccggcggccacccgggcgggccgcctgctgctggaggtgctctccgaggtgcagaacaccgtccccaacttcacgctgaagtacgaccccgaggtcacccccgacgcctttgcagaggcggccatccgctgttccctggcctgctccaacccggccctgtgcagccatcccgccaaccgggacacctttgacgactacggcgtgtcgagctgttacaacatcctgcccatccggggcggcgcctacaccctcacccgggtcaccctcacccgcctggtggacgacgcccggggtgtggagcactttgtggaggagctgctcccggagtgcctgcgcctgacgaccgactacatgaacgagcgcatccgcttcctggtggagcagtccggcttcttcccctccagcttcctggtccaggagggccttatctccgccgaccgctttctgcccatgttcggcgtcaccggtctggccgaggcggtcaaccacctgctccgggaccgggggctggtgtatggccgtgacggggaggccgacgcgctgggcgtgcgcatcatggagaagatcgacgccgtggtgaaaaccctccccgccgcccactcccccctgaccgggaaccacttcctgctccacgcccaggtgggcctggactccgacgtgggcatcacctccggcgtgcgtatccccgtggggagtgagccggagtcctttgccgaccacctgcgccactgcgcccggttccacccctatttccccgcgggggtgggggacatcttccccatcgcctccaatgtggagcagaaccccgccgccctgctggacgtggtgaagggggccttcgcccttggggtacactacatgagcttctattccgcggacaccgacctggtgcgcatcaccggctatctggtcaagcgcagcgagatggagaagttccgctcccaccaggtggtgctccagaacaccacccacctgggcacggccaactacgacgtcaaccgcctggcccagcgaaaggtgcggatggtatgagcgccgccgcgccagtcaaccggattctccccctctccaccgtggacggccccggctgccgcgcggccgtctttctccagggctgcaacctggcctgcgcctactgccacaacccggagacccagaacctgtgcaccgggtgcggcgcctgcgtgcccgcctgcccggcgggggccctgtccctggagagcggccgggtgcgctgggtggcggagcgctgcgccgggtgcgatgcctgcatccgcctgtgcccccggttcgcctcccccaaggtcaccgtcatgaccgcttcggaggtgctctccgcccttgcccccagccggccctttatccgcggcctcaccgtctccggcggggagtgtaccctctacccggactttctcaccgagctgttcaccctggcccgggccggcggcctgggctgcctgctggacagcaacggcatggttcccctggcccccctggccgggctgatggcggtgtgcgacggggtgatgctggacgtgaaggcatgggagcccgccgtccaccgggccctgaccggggcggacaacgccccggtgaaggagaatctggcctttctgtccgcctgcggcaagctggcggaagtgcgggtggtgtgcgctccggacgcggtggatgtggaggccgtgctggacggagtggccgccgcgctgggccccagggccccctccacccccgtcaagctgatcaccttccgccctaacggggtgcgcggcgctctggccggccgcccctcccccacgccggagcagatgactgcctggcgggcgtacgccctgagcgccggactgggcgccgtcctcctgcgctgaccgtgcccccgccctccccggcgggggcttttcattctgcggccaacgttgcgcgccggggggcaatgtggtagaataaatcagatatatctcccttttcgggtgaactggatgggaaatcagtctttagggggggcgcggggatgcaccgacgcaaaagctttctgttccgcctgtttgcgctgctgtttgccctgctgctgctgatcaccgcctccgtggagctggctctttaccactacgcccgccaggtggtggggcaggagtacatccgcctcaaccaggcgggcctgcggcagatcagctacacccttggccagggcatgaccgatacccagaccctggccaagcgcatcgctgagagcacacagctcattgaactgctctccggccccgccggagagcgggcggacgaggccgcccacgatctgctctacagcctgagcagcgactatgtgtggcagcggggcatcaaaatgctgatggactcctatgtggtgggcttcaacggcgtgaccgctgccacttacagctccaggcagttcaactatgacgccgtcctggccgacccccggtatgagcccctgttcagcggaacccaggacgccctgctgctgcccaccaccacccatccggaggccacaggcatctttgtccactccttccagtacgcccagcttatccgggaccacctgactcaggagccgcttggggtggtcatcctcaacatcagcgaggtcagcctgtactcccaatatctgcggcaccagagcgccgacaaccgattttttctgaccgacgggtcgggcaccattgtctcagcccgggacaagcagctcattggttccatctatgcctataccccggaggaattggacgccctggcggctgagacgtccctctccagccgcattgacggcgggcagatccgcctgtatgaacgcataccggggacggactggtatctggtggaggagatgagtgcctcggcggccttcggcacgctgaatctggtacgcaatggcgctttcctggccaccggcctgtgcgccgccctgattctggcggtgcttctctacgcctaccggcagattctccgccccatcacccagctccaggccagcctgggccgggtcatggagggccgcctggacgagcgcatcgacgtacgccgaaaggacgaattcggccgtattcaggaggccttcaacggtatggtggagcagatctccacccttctggagtcggtcaaacgggaggagcgggagaagcatctggcggagctggattttctccaggcccagatcaacccccacttcatctacaataccctcagctccatccgcttcctgctggagatggacaaggtacaggaggcgggggagatggtgttctacttctccaagctgctgcgccagaccctctcccgctcggtggagttcatccccctgggggaggagctggacacgctgaagtgctatgtggagctccagcacctgcgctatcccgatacctttgactactcctgcgaggtggatgaggccctgcgggacaacacgctgcccaagctgctgcttcagccggtagtggagaattccatcttccacggcgtgggccggcacaaaatccacatccgcctgcggggctggctggagggggacaccctgatcctccgggtggaggacgatggagtgggcatttccaaagacaagatcgaccaggtgatgaacaaggacttgcagattaaccgggtggggctgaagaatgtgcaggagcgcatccgcctcaactacggccccggctacgggctgacggtcaccggcggcccggcgggcggcacggtggtcaccttccgcctgccccgcacccgatagagaaaggaggagctccatgcttcatattatggtagtggacgacgaggcccccatccgggactggctggtgtactgcatccagaagtgtgaggcggccagctccgtcacctccgcggtcaatggagaggaggcctaccgcaggattttggagcagaagcccaacgtggtctttaccgacatccgcatgccgggaatggacgggctggagctgatgagtaaagtccgggacatcctcccctttacggtgttcatcatcctgaccaactacgccgagttctcctacgccaagcaggccatctccctgggcgcccgggagtacatcctcaagtcggagatgcgctcctccgacattcagcgcatcgtagcggagattgcggccaccacggcgaagatccgctcggaaaaggtgcatgatgtcctccaggacggggtggtggacctctacgagatgtaccgcaatttcgaacagcccggcgctgtggccgccttctggcagcggcaggggctgcggcccggccagccctatctggccttctgcgtggccaacgacagcagcctggacctgcggcggcagatggtggccctggcctccgcctcccgcgcccccttctctgcggccgccatggtgcaggagcacctctacctgctcctccagtgcccggaggcggaggccctgcggggctatgccctggacacggaggccgccctgggggagtgccgcctgcccgccggcgtgtccgccctgtgcaccgacatcggccagctcatccgtgtgctgggggaggcggcatcggctcaggaggcctgcttcttcaccggcggaggggtggtgccctactccgccatttgcggcctgccccccattgaccgggaggccgcccacgccagaaagcaggaggtgctgcgcctcctggcccgccgccaggtggaggaggcccgcggggcgctccgggcctggttcgccctgttcggcatggtgggagccgatgacgtgcgctgggcggtggacacggtcaaccgcatggtgatctccatggaggactggtactaccagttcgtcacgccccccgccgacggctgggagccgccccattccttcaccgcctgccgcagccgctgctcggccatgctggagcaggtgctccgggaacggcgcagccgccactcccggcccattgagaccgccctgaactatatccacgcccactacgcccagcccatctccatggcggaggtggccgcccagctctaccgctcgccggagcacttttcccgccagttcaaggaggaggtgggggagaacttcagctcctacctcacccgctaccggctggagcgggcccaggagctgctccagaccaccgatctgcccgtcgccagcgtggcggtacagacgggctataccacccccggatacttttcccggctttacaaaaagtacaaaggcgtgtccccggaggcggagcgccgggggtcaaaatcgtgacaaaaaaatcaaaattgtgacatttcccgccccgtgcggaaaaagatatcatattcgtcccaaaaacggtcaagcctatggctcgaccgtttttgttttctttgttaaactcaacttgtaagcttgggccgggcacgcccaaagtgtccctgctgtgccgaatgaattgaaggaggaaccctgtcatgaacgcaaagaaactgctcgcgctctctctggcctgtaccctcaccctcggcctgtccgcctgcggcggcggccaggacgccccatcttccggctcccccagcggcgcctctgacggcgacgccctgaaggtgggcatcatcctgtccaccggcggcctgggcgacaagaacttcaacgatatgacctacgccggcgcccagcaggcggaaaaagacttcggcatcgagtttgactatgtggaaacccagagcgccagcgacttcctgcccaactaccgcatgttcgccgagagcggcgagtacgacctgatcatcggcctggcggccgaccagaccgaggccatcaacgagatctccatcgacttccccgagcagaagatctcccacatcgactcctccaccgaccttcccaacgtcagcgccgtctataccaagtggcaggagcagaccttcctgaccggcgtggtggccggcctgggcaccctgtccggcatggacaaggccaacagcgaaaacgtggtgggcgtcatcctgggccaggatcagcccaccctgcgcatgggcgtagtgggctttgaggccggcgtgcgctacgtcaaccccgactgcgaggtgctggaggccgtcgtgggcgacttcaacgaccccgccaaggccaaggagatcgccctgtccatgtacaaccgcggcgcggacttcgtccagcacatcgccggcgcctccggcatgggcgtcttcaccgccgccaaggaggccgaccgctatgccttcggcgtgggcggcaaccagaactacatcgagcccgactacatcgtggccaccgccctgcgcgacgtgaacaccatcgtctacaacgaaatcaaggccctggtggagggcacctgggagcccggcgtacacatcagcggcattgccgagggctccgtgggctttgacaacaccgactccaacgtggttctgcccgacgacatcgccgccgccgtggaggacatcaaggccaagatcaccgccggcgagctggtgccctgcgagaccgccgaggagctggacgcctgggtggccgccaaccagtaccagcccgcggagtaagcgggacaccctggtgtgcaccccgtcaagtagacagcgaaataatttacattttacgcatgaaaatccttcctgcataccatatggtgctgggtgctatgcagccagtagacggtcatggacttccataggggtccgcacacccaggccgcgctggaggcggtggaagttgtaataggtgatgtactcctggatcatcttgaccaactgctcccggctggtgaaccgcctgccatagtagcgctcccgcttgaggatgccccagaagccctccatggggccgttgtcaatgcactttcccacccgggacatactctgtgtaatgccagctgcagccagcttgtcatggaagatctgagtggtataggcgctgccccggtcgctgtggagcagagggcgggctccgggattgccctccaatgcctgagccagagtgcgatggaccaaggcagcgtcgttggtgtcccggatgacaaaggaaacgatgcgccggtcacacagatccaggatggcgctcaggtagagcttgcgcatgttggtgcccgtatagtagtgaaactccgtcacatcggtgagccacttttcgttggggcggtcggcgtaaaattggcggtccaacacattctccgccagctgtcggggggatgatgccgcccgagtgcagccatgtggggcatgttttaccacagactgaatcccaaggccacggcagatgcgcagtgtccgcttatcgttgaccggcgtatggtaatacttgtccaaatcgtcccgaatgcggcggtatcccttgtctgggctctcccggtggatctcctgcaccaactgggcgatgcgctgattctcggcgacgcggcccccggctgtcccggagcgccactggtaatagctggcccgggagatatgcagtgcacggcaggctggccccacaggaaatccctcgttttccgtaccgtagcgcaccgcttcatactgctgttcctgccgaaactgcctcagcgatcccccctttccagctcttgcactttttttcgcagatacagttccattttcagcaattcattctccttcttcaaccgggcgttctcgatccgcagggcctcatcccggctccggggcgtttggtccgccaggcgcttgccacgccggtcctccaatcccgcgggacccaactcctgatactttttcacccagctccgcagcgtctgtacggctacttggtgtgcctgcgccacctcttggagcgcccggccgccctccagacaggctagcaccgcctccagccgttcctctatggtgtggtcgttcctcatgatagttcctcctctttctctcttggagtttctctcatgatacgcctttacccagtccaataccagattcccggagcgcaaatgatacttttccgcgatggccatggaactgccctgaccggacaggtactcctccgccacttggcgcttgaagtcctcgctgtacttccgtttggagcgattcccattctcctccaatgccgaaattccctccgagcgataccggctgatccaactctccatggtggtgtgccccactccggcccgacgcgccgcttcccgcatacgcagccgtcctgcaagatattcctccaccagcgagactttttcctcaaaagcaacttcttttcgtttgcccatcctgtattcactcccaatgttattttcctgtctgctttattgggagcataccaccccggccccagcggccgataatctgccgggaggcgatgacgtttgaacgcagttgaaatgcgcgggattgtcaagcagtatcccctcgtccgcgcgattgacggcgccgacttcaccgtcgagcagggagagatccactccctgctcggcgagaacggcgccggcaagtccaccctcatgaaaattctgtacggcatgaccccccccaccgccggagaggtgcgcgtcttcggcaagccggtcgccatcacccgccccgcccaggccatcgccctgggcatcggcatggtgcaccagcacttcatgctcaccccggtcatgaccgtggcggaaaacgtggtcatcggcagcgagccggtgcgcggcgttttctttgaccggaagaaggcggaggcccaggtcgccgccatgatcgacgagtataacttccacatctccgccaccgccaaggtggagaccctctccgtgggtgagcagcagcgggtggagatcctgaaggccctctaccggggggccgacctgctgatcctggacgagcccaccgcggtgctcaccccacaggaggtggaggatctcttcctggtcatgcggcagctcaaggccgcgggcaagagcatcattatcatcacccacaagctcaaggagaccatggagatcgccgaccgggtgtcggtgctgcgccagggcaaaatgatcgagagcggcgtccccgtggcgggaaccaccatgaacgagctggcccagatgatggtggggcgcgacgtggagctctccgtcacccgccgggccgagcaggtgggcgaggaaaacttttccgtgcgcggcctctccctcaccgagcggggcgtgcccatcctgcgcgacgtgtgcctctccctgcgcaagggggagattctgggcatcgccggcatcgagggcaacggccagaccgagctcatcgaggtactcacaggcctgcgccgccccgaccatatggagctgttcaaggacggcaagcccctcagcggcaacgccgccgccttcctggccgccggcgtgggccatgtgcccgaggaccgcatgacccgcggcctggtgctggagatgagcatcgaggacaacctgattctgggctaccaccgccgccccgctttcgcccgccgcggcctgcggctggcctccgccatccgcagatttgccgagcaggagcgcaccgagtttgccatcaaggcccccaacgtgcaggagcggtgcagcgccctctccggcggcaaccagcagaaggtggtcatcgcccgggtgttcagcgaaaaccccgacgtcatcatcgtggcccagcccacccgtggcgtggacgtgggcgccatggagtacattcaccaccgcctgttggatctgcgggacggcggcaagtccattctgctcatctccgccgatctggacgaggtgcgcagcctgtccgaccgtctggcggtcatctacggcggccggatcgtggccgagggcaagccggacacctggagcgacatggagatcggcctgctgatgaccggcggcagccttgcgccggaaaaggagggaaccgcatgaaaaagcgtgctctgagcggtctgctcaagctggatggcccgctgctgtccattctctccctgcttatcgccattgtcatcagcggcgtcatcatggcggtgtgcggctacaaccccattgaggccttcggcgccatcctggccggctccttcggcagccagcgcgccattgtccagaccctgacccaggccacccctctgattttcaccggcctggccttcgccttcgccaagaaggccagcctcatcaacctgggtgccgagggccagctctacatgggcgccctggcctccgctgcggtgggcatgctggatctgggcctgcccatggcgctccacctgcccctggcggtggcggccggcatggccgccggcggcctctacgccggcctggtgggcgtgctcaaggtcaagttcggctccaacgaggtcatcgccaccgtcatgctcaactccatcgccacctatctggtggactacctgctcaacgggcccatgctggcggagaacagctcggtggcccagacggagcgggtgctggagacggcgcagctcccccgcatcttccagcagtaccagctcaccgtcgccatccttctggcagtggcggcctgtatcctggtcaagctgttcatggaccgcaccgccctgggctatgagatccgcgcggtgggcctcaacccggacgcggcggagaccgccggcatcagcaaggccaaggtcaccatcgtggccctgtgcatcagcggctgcatcgcgggcctggccggcgccagccatgtgctgggcgtggaccgccgcctgatcaacggcttctccaacgactacggcttctccggcatctccgtggccgccctggcggcggacagccccgtgggcgtcatctttgccggcatcgtgttcggcgcgctgcgggcgggcaccatggagctcaaccgcaccaccagcattccggtggagttcgtcaacgtcatccaggccatggtggtcattctggtggccgccccgctgctggtgaaggagctcaagcggctcaaccccgcgggctggtcccgcaagaccaagaaggaggtggcctgacatgggcgtgattctcaacaacctgattcccatcatcggctcctccatcgccatgtccatccccctggtcctggcctcggtgggcggcgccttctcggtgcgcagcggcatcatggccctgggcctggagagcatgatgatgatgggcgccttcttcggcgttctcggctcctacttcaccgggagcgtgctcttcggcttcctgctgggcatggtgggcggcatggtcatcggcctgttccacggcatcctgtccgtgcgctacaaggtcaaccaggtcatcagcggcatcggactgaacctgctggctctggccgtcaccaccctgctgatgcagctcatctggaacaacaagggctccaccccccaggtggcctccatctccaccaccctggacttctttgcccccatccccgtcatcggccccattctggcccagcagtccgtcagcttccttgtgatggccgctgtggtcatcgtgggttggattatcctcttcaaaacccgcttcggcctgcgcctgcgcatggtgggcgagaacccaaaggccgcggccaccatgggcctgcgggttcacggcatcaagtactgcggcgtgctcatctgcggcgcgctggccggcgtgggcggcgcctacctgtccctggatcagttggatatgttcgtgcgcaacatgaccgccggccgcggctacatcgcggtggccatcgccatcctgggccgctacaatcccgcccagatcgtgccctgcgccctgctgttcggcttctgtgacgcggtgcagatctaccttcagggcgaggccttcccgccccagatcgtgcagatgctcccctacattgtgaccctgctggtgctggccttcggtgtcaagcacatcaagcccccggccggtgtcggtaagtacgacgacgaatagaaagctgaggttgaggtattatggaacagattcagaacaaccgagtcattaccgatctctatcgggagaacgcacagttccccggcatcgcgctggatggttccgacgtctatctgtgctggcagcgctttgtggaccgccacgacagcctgatggcctcctgccgccggggggacgaggtggtgtgggagcgcgagatctccgacggcggcgaggtgctccacccagtcattctggctcacggcggcgccatctggtacgcctggagcgagtacgcccgggagaactggcgcatcctggcccgctgctatcgggacggccagtggggcgaggtgctcaccgtcgcctccggcgaggccctgttcttcccccgcctgttcacctggcagggcaagctgcacgtcatctggacggagcagcacaagggcagcgcggccgccgtgctgtgccccctgaccgaggccggccccggcgcggccgagaccgtgtccgcggtgggcgaggcctaccgggccggcgcggccgagggcggcgacggcaacctctatgtggcctacgacggctttgacggcaagcagtacaagctctttgcccgggcgcgcaccgccgcgggctggagtgaggagattgtggtcagccagggcgaggactgggcctccaccccgtggatcgccgccaagcccgacggcgccgtggtgggctggtacgactacggctatatggccgtctactccgtccgctccgccgacctcaccgtccgggacggcgccctggccgcggtcaatccccagtgcctcaaggagggcgtggactggtatctggatctccacgtggcctccaactcctccggccttcaggccatggcctacacccgcagcaagtacgacgtgctggtgtgcacccgccggggcagcgagccctggagccgtccggtgctgatgtcctacggcgacggccactgcggcgtccaccccaagctgctggtgagtgaggacgacaccatccatctgatgtggcagttcggcttcaagaacggccacatggagcgcaacgcccaggtgatctacaaccacctcacccccgccgagctggcccagcagcccgactatgtggcgccccccagcgacttcacccagcccatccccgccaacgccgacaagcgcctggacgagcaccccgccgacgtggtgcgcgcctggctggacaagaacggctacgggaacctgtccgtctactttggcgacatccacggccagagcggcctgtccgacggcatgggcgaggtggaccagtactatcaccgggcccaggacaaggcccgtctggacttcaccgccctcaccgaccacgactgctaccccgactggacgacccagtccgagtgggagctgctgcgcaccaactgccgcctgatgaacaaggacggcgagctggcctgcctcctggcctacgagtggactcccaacgagtacaagtacgactacggccacaagaacgtgtactaccggggcgacgagggcgagatcttccgctccggcgacaagggcggcatgacccccaccgacctctacaacagcatccgctcctacaaggccctctgcatcccccaccaccccgccgcggactgggtgatggtgagcgccgccaccgactggaacttccacgatcccgaggtgcagcgcgctgtggagatctactcccgccacgcccccttcgagacctttgaggcccgctccaagttcaccaagaacatcaagaagatggagcggtgcagcgtgcaggacgccctggcccggggctaccggatgggcttcaccgccggcagcgactcccaccagaccgagcacggcgtggagggcggcattgtggccgccttcgtccccgccctcaagcgggagtacgtgtgggacgccatctatgaccgcctgacctacggcaccaccggcgcccgcatcctggtctccctgaagatcaactccgcccctatgggcagcgaggtcaaggccatcggcgacgcccccgtcaccatcgagggcagcgtccttggcaccgacaccgtcaccgtggagctgctacgggacaatcaggtcatccagacctgggcctgcacgggcaatgcctgcgacttcaccctggaggacaccgccgggagcggcgcctgctactatctgcgcgtcacccagaaggacgagcacatggcctggtccagccccatctgggtggaccgcgcctgaccccctttccagcaaacgaaaagcggaacggctatgccgttccgctttttcaatttgccgaagcagcgtttcgacagggctccggacattatgccattccggttctgcgccggcgcgtccggcggcgcggggactccggccgccgcttggggagagccgggggccgcagggccacgctcccgccgtccttggcggcggaaaccaggtagccgtagacccgcagcttctgttcgtcatagaggtccagcgcctgatagagccgcttgtaggcggcgaacatggtgcgcttcatctccaccgtccgggccagggtggcctgggtggccaccaggctgcccggccgcttcacatagcagtagaccggctgggcggtggcggcgatcagccgggcccggcggatgtactccaggttgaagaggaaatcctcgcaccagctcacctccggatcgcaccgcaggcggccctcctccacaatggagcgtcggtagagcttgttccacagcacgccgtagtagaagttggccggggccttgagcatctcctccgcgaattcccggcgagtgaacaccccctcccggcgaatgtggccctggagggccttgcgggtgccggccacccgccagaagcggccgatcaccagatcagccccggtggccccggcggtgcggaccagccgctcggtagcggtggagggcaggtagtcgtccccgtccacaaactggaggtactgccccgtagcccgctccagagcggcattgcgggcggcggataccccggcgttggcctggtggagcacgtgaaagcgggagtcggcggcggcccgggcgtcacagagggcggggctggcgtcggtggagccgtcatccaccagccacacctccaggttctcccacgtctgggcggcaatggagtccaggcagttgtccagatagggctccgcgttgtagaccggcacaataatgctgatgaggggctgctccacagttcacgctccttccggccggggcgtcagcagccagcctgtcatgggcgggagcgtctgctccccctgctccagggccgccccggtcatccagtcccgggcgggccagggcagatcaatgggctccggcctgtcgccggcgttgacggcggccagtacactcccctcggccccggtgcggaggaaagagagtacccgtccccgggtgagcgtccaggccagctccccccggcgcagggcgggcagcgcccggcgggccttccccagggcggtgtaccattccagcagctcgccgtcctcccttccccaggggtaggtgcggcggttgaaggggtcttcaaagccctccagccccgcctcatccccgtagtagaccatgggggagccggggaagccgaagagcaccagcgcccccagcttcagccgggctttccccagggcgtactggccgggggacatgcggaaggccgcccgccagtccttgtcgtgctcccgcccgtcgccccccgtgcccagcagggtgaggatgcggggggtgtcgtgggtgcccaggaagttcatggccgagcgccaggcgaagggcgggtagttctcccgcagggtctccatggcctgccggaagcggaaggcgtcctcgcccagcaggaaggacaccagtgcgtttcggaaggggtagttcatcagcccgtcacagtggccccccaggatgtgccggcggcgcacgccgtaggcaatcttgttggagccgtcctcccacacctcgccgatgattaccgcctccggcttggcctgccgggcggcggcgtggatgccgtggataaagtcgtcgggcagctcgtcggccacgtccagccgccagccgtccgccccggcggccagccagcggcggatgatgctgtccgcgccgccgaagatataccggcggtaggaggggtcggcctcattgacggcggggagggagtagatgccccaccaggagtcgtatttgtccggccagtgtgagaagtggtaccaggggtaataggggctatcctgggactgaacggcccctatgctctcataggagccgtcgccgttgaagtagcggctgacgtagccctggtggttgaacacgccgtccagcaccacccgcatgcccagggcgtgggcgtcggtgcacagggcgcggaagtcggcctcggtgcccagcatggggtcgatcttctcatagtccccggtgccgtagcggtggttctccggggcctcgaagatggggcagaagtagagggtatccacccccaggccccgcaggtagcccagcttctcccgcacgccggccagatcgccgccgaagaagtcccggttgcgcacctcgccgttcgagtcggggcggtagaccggctcctcctcccagccggtgtggacgctccgccctcccaccatgccggtgggatcgggaacccgggtgcggcggaagcggtcagggaagatctgataggtgacgccctctccgaaccaggcaggcacctcctccgccccgtcgtataccgtgagctggaagggccccagctcctccctgcggccgtccaggccctccaggcggaaggagtaccacaccaggcccacatagtccccggtctccaaggttacggcaaacacatcccggtccccctccaggccccgccagggcatgggcagctcccggcgctcctcgtcccggtgctcaaagtaggcgatgagtgtggcggcagaaaatcccccggcccggggcgggcggagggccagctctacccgggtgccggagggtacggcgccataggggcgcttataccggctgtcccggctgtcaaaggtctggggatcacacacaaggaacggctcccttcagcggagcagggtgttctcggcgtccaccgattccaccgtatgctccgcgctgaaatagtagttgacaatctcgccggcggcctgggccagatttccgcccgaggcaccgccctccaccacgatggagatgacgatctccgggtcgtcatagggggcgaacagggtgaagacggcgtcggcctccttgtccgccgagcccacctgggcggagccggtcttggcgcccacctccaccgccaggttgctcaggtactggtccacggtgctcttggggtcgttggccacctcccacatgccccgcttcaccgcctccacgttggcggggtcgagagcaatgtggtttttcacctcgggctgctgctcatacaccgtctccgagtagtcgctggacttgacggacttgagcaggtgaggcacgaagtgatcgccgccgttgagcagggtaacgatatagttggccagctgaaggggggtaacctgggtgttgtcctgaccgatggcggcgttgagcaggttgccgccgtaccactccacccccagggcctcgctggtggccggtccggccacatagcccttcacctcgggcagttcgataccagtgtactctcccaggccgaacagggaagcgtactcgtcgatcttgtcaatgcccagccggtgtcccatggtgtaaaagtagatgttgcaggagtcccgcagggcgtcggccagatcctcccacccgtggttgcctccgtactggcggtagatccagcactggggatggaaatcgccgtaggggtagtgctcctcctcggggagctggaggcggccggtgtcctgaattttctccgtgggcgtggtcagtccctcctccagcgcggcgatggccaccagcggcttgaaggtggaaccgggatagtaaaactcctgggtggctcggttgagcagcggggtcagctcggtgtcgctggccagttgattgtaaagggtgatatcactgtagatcctggacagatcgtaggtgggataggaggccatggtcaggatctcccccgtcttgacgctctccaccaccaccgcgccgcccccggtatcctccgactccagagtctcgatggtgttggccagaatctcctccaccttctcctggaggcggaggtccagagtgagcagaacgttgtcccccggcttggggatctgctcctctccggtctcggggtcgatgcgccagtactcgctgaccacctttccactggtggacagctcctggatctgaacccctgactccccacgcagatactcctcaaaggcgttctccgccccgtcgatgcccaccttgtcgttcatgctgtagccctgctcccggtagtagtcccagttgctggactggatgtctcccacatggcccagcaggtgggctgcggctacagtgttgtactgacggacggtggtggtttcgatggtaacgccggtaagccggcgctctttcaccgcagagatgacatcaatattcacatcctgggcaaagatgtacgcctgctggttgatgctgtaggtgcgcagattggtctcgtagagcacaccgatcagggcccgggcgtcggcgtccgaccaggacgggtcaatctcaaagtaggtgcgcagggcggcgatcagctcctccgccgtgggcccggcggggatatcgtccagggtcttggcgtcctctacctgctcggtggtgggcaggttcaggctgcttttcagctcctttttcatagggagggcgttgagcagccgtcccagccgggtcagggccacgccgcccccctccttctcgtaggccagaggggtgtcgctggtgtaggtgaagggggctgccgttgagacggccagggtgtcggtccaggtcaggccgttgtcccggcagatgttgagcagctccagcaggttggcgttgcgcaccgcctcctcccccatcacaccggtattcagcgtgagctggtaggtggcacggttggtcaccatgctccggccgtagcggtccagcagctccccacgggcggcctccaccgtcttccggttggcaatcttgaccacgctctgggcccggtagtcgtccacatggagcacctgcaggttgtagagcaccccaaaaaacagcagcagcagtgccgtaagcaccaccaggatggcgagggtgcggcggttgaattgtctgccctccatggcgggccccctttttcagtctatgaggccaccccgcgttcggtggcggggcggcctgtctttacagcacggtttttttcggcacccggcggaacacccacaggaacagggcgtacaccgggaacacaaagaccagggaccagagaatctcccgtccggccaagccgagcatggcagccagctccccccgcccggccagcaggcgggcggcgatgcgcaccccgtcgatgagcgccagcgccgcgaaggagcacagcaggcagcccaccaggttctggcgcagcacatactgggccagggcgccggcccccacgccgatgaggcacagccccaccgtcatggctccgtcggtgttgaagtaggccgcgtcgcacaggatgcccacgaacaggccgaagcccgcccccgccgtggtgccctccagcaccgccacgcacacggcagccaggggcaggagcataggggccaccccaaagaggggaaagcggttgagcacaaacagctccaggaaccatacgggcaccagagccagggcgtatacgccccatttaatgagaaaatcctgtctggtcaccggcgcttcccccctttccggccacgtcccatttattcgttaacggtaaagtcggtgatcacaaagacctgctggaggccgtccagatcggtctccggcgcaatgacggcgtagcgggtcatgccggaggcatcggtgcgcacctcctccacgtgcccggccaccagtccggcggggtataccccgccccggccggaggtggtcaccagatccccggcgatgagctcgctgttctccggcagataagtcagcttgagcctgccctcccccatgagggcaaagtctccctccaggatggccgcgccgccggttcgggcgagctggccgcccatctcggtgtccgagtcaacgagggtacgcacggtggcccagttctcccccacctccgccaccacgcccaccaggttccagtactcgtccaccacgcagtcatccacggcaatccccgcagcgctgcccttgccaatggtgagggtggactcccagttggaggtggagcgggcggtgaccatggcggcggccttgtcgcaggaccactccttgggctggagctccagcaggttgcgcaggcgctcgttctcctggagggcggcctccgcctcccgggcctgggcctccagctcggcgttgcgctgtttcagcccggccagctcctccttcatctgctccagctcgaaagcatcgttgtacttctcctccgcccagttggtcactgcggtaatgccgttgcgcaccggcgtggtaaggatccccaccaggttggacagggggtcggccacaccgccgaacagcatcgacaccaccgccgtcaccagggccagcagaatggctgcgattaaaatcaggattccgttgtgccggaaaaaatccttcacgtctgtccgttccctctctctcagtcgctgtcccgctcgcccgccgccaggcgcaggcagtccacgccgagctggcgcaggatgccgcccaggcggcacacgggcaggcccatgacattgtagtaatccccctggatgccttcaatgagcagagccccaaagccctggatgccgtaagcccccgccttgtccatgggctctccggtctggatgtagcaggagatctcctcctcgctcagctcccggaaggcgacggtggtctcctcgctgacggtgtgccgctcctccccccgcaggacggtaaggccggtatagacctggtggcggcagccggagagggtggagagcatcttgaaagcctccagctcatccgcgggcttgcccagcaccgccccgtccagagccaccaccgtatcggcggcgatcaccaccgcatccatgcccgcctgctcccgcacggcccgggccttctccgccgagatgcggcgcaccagctcctccgggggcagctcccgctccatgtgctcgtcaatatcgggggtgacgatgcgaaagttctttatccccatgcgctccaaaagctcccgccgccggggcgactgggaggccagaatgatctccatacttctgttcctttcctaattggccggaggggcgcggcagccgcggcgctccgcccggttccatgctctttcgcgggcgggtgtgggcgcccgcccctacacatccaggcggcctgcatcggttcgctgtgtctgccctgtaggggcggcccttgtggccgcccgcgggcggggacgagccccgcccctacacgtcccggcggcccgcaccggtctgctgcgtctgcccttactttccggtggagccgaagccgccggtcccccgcccggtatcgtccaggctgtccacccgctccagctcggcctgcaccacgggcatgacggccagctgggcgatgcggtcgccgggctggacggtgtagggggtgtcggacaggttggtcagccccacccggatctccccccggtagtcgctgtcaatgacgcccaccccgttggagagggcaattccgtgcttgatgcccaggccggagcgggcgaacaccagggccacatactccgccgagggcagggcgatggcgatgccggtggggatactcaccagggcgcggggggccacctccaccggcgcgtccacgcaggcgcacagatccatggccgccgcgccggcggtggcgtagaaggggtaggggatgtccttgccgatcttgtccgatacggccttgatcttcagcttcatggggttcactccacatctcgatagtatagcccgcgggtgtactcgttgggggtccagctcccctgctccagatagcgctgggccacctgcacgcactcccggggattttcggtggtaaagagcagccgctgggcccacaggccgatgcggcggtagtcggcggccctgtccgctaggaagagcttctgggagttgagcagctcgttgcggcagccgggggcgctcaccaccgggaagcgggcgcccttccggtcggtgaggatattggtgttctggcagccgcaggagccggtgcggtttctgatgatgcagttctccatcagcatcaggggcaggcggccgtaggtgatcagctcggtgtccaggcatttggagaggtcgcggatctgggccagcttcagctcaaaggagagggtggccgactggaggcccagccgcttgtactccttgagggcctgggcgttgtagatctccaggccgaagtccccccgcagggtgaagcccagctcccgggcgatggggaacataccaaggttgcccagcagggcgtcttttacccccaaagcgcgcacctgctccagcttttcccgcaggccggggtactcccggtcccaggccacccggggcaggctcaccccgatggaggtgtgctccgtgccggcggccttctccgggtgggcggccagctcgtccagcgggacgtacaccagggcaggcctgaggcggagcagctcgtcggtgagctgttccgccctccgcacagagatggtcagcaccggctcctcccgccggttctcatagcgggcaccggcgtggtattccccggtgcggcggcggggcggctcctgcctctggacggagagcttctccagggcctcccgccgcagggcgttgagggcggccagggggagggataggttctcctccaccagggcgcgcacctgcccgcagcggtagggggtgccgccggtgcgggagagctgggtggtgaccgcctccgccgtcagggggcgggtgcgggcggcctcgggcaccgggccctccaccgtcgccacccggccgtccggatcctccacccccacgcgggcgggctcgccggggcggagcatggcgtagaaggtgacgggcacccgctgggcctccccgctctgataggtattgcgggcggcggcgaagagctccttcggctctctggtctcctcccgcacgccgaacatgtccggcccctgctgatccaggtagtagccctgggtgaagccctggcgggagaaggcggcccggagctgctccagctcctcccccgtcggctcccgatcctcccggatggcccgggcgtagatgccggtgaccacggccacgtactccggccgcttcatgcgaccctccagcttgacgcaggccacccccatcctgcgcagctcctgcaggtgtcccgccagggacagatccttgagggagagggggtaggcgtcggccttgtccatccagccgtacttgaggcggcagggctgggcgcacaggccccggttgccgctgcgcccgccgatgacggaggagaggaagcactgtcccgagtagcacatgcacagggccccgtgggcaaagacctcgatttcgatgggggcgcgctggcagatgtattcaatctgatcccggctcagctcccgggagagcaccgcccgggtgaggcccagatcggcggccatcttcaccccgtccaggttgtggagggtcatctgtgtggaggcgtggacgggcagatcgggggcaacctggcggagcatccgcagcacgcccagatcctgaatgagcaccgcgtcggcgccgatggcgctggcctgggcggccacctccgccgccttgggcagctcccggtcggtgagcagggtgttgagggtcaggtagacctttgccccccgcaggtggcaataagaaaccgccgccgcaaactcctcctccgagaaatttttcgcgttgcggcgggcgttaaagtccccgtatcccagatagacggcgtcggtgccgttctgaacagccgccgccacggcctccatggacccggcgggggcgagcaattccagcatagacggaatcctccctggcgggggcggccaaagccgcccgctccgctctcttacttcttgttctgcagcttgaagatctcccgcttggcctcggacagctccagcttcatcttggtggcctcctccaggtactccttgagctggcggcgcagattctcggcggcctccacctccttgaagtactcgtcggcaatgttgaccgccgccaggatggccccatccaccagggacacatgggctccgctcaaaacctcctccaccttggcgtccacgtgggcggccaccttctcggtgtagctcgcctcctcggtgcccaccagcgtatactcctgtccggcgatggtgacggtgacacggtttttcatggaaacccctcctgaccatagtgatttaggattcggacattataccaggaagcatcagcggaatggtataatgcgctctgtttttcggttgccccgcaaggggcgggaaaaacggctgaaatgcaagtgtaatagccgctttgcggctattataccatagttccgcccggatgagaaatgaaatcttcatgaattttcattttcccgcccggacggcaacctgtgccgctgctcacgacggctccgcgctttctgtcacgctctgcctgttcgcgacgcggtcactattccccgctccgccggaaatgccgccgggcttcggccggcctgttttccggcctgcgcggctcactgtgccgcggctcacgacggctccgcgcttctgtgttgtcacgctgcgcgccctccgcgacgggcaactgctcgtccctccgcaaaaaacaccttgcgcctgcggcgcaactgctttttcgcctgcgggtctcgctgtttccctgctcccgggcgctccgcgcttctgtgtaggggcggcccttgtggccgcccgcgggcgggtgtgggcacccagcctgcattttctcccttcccatatggccgcggccccgcttgcccctacgccgcacgccacgcagggggccgatatccacagtatacaccgcgcgtagttttatgctataataggcgggaaaccaaagaggaacgggggattcacatggccgagctgctgctgcccggtgacattctatccatgacggcccgggcggccgaccggctgatgggcgcgggaaacggggacgcagcgctgctgtacctgtggttgctgcgccggggcggacggctggagccggaggcggcccgccgggcgctgaagtgggacgtgccccggctggaggcggccctgtccgccctggtcgggctgggcctggcggacggcacggccgcgccggaggcccccgcccggatggagccggagggcccgccggagtacaccgccgccgacatcacgcgggagctggaggacggcgcctcctccttccccggcctggtgaacgaggtgcagcggcgtctgggcaagatcctgtccacgtcggacttgaagagcctgtacaccctctacgactacctggccctgccggcggaggtgatctgcctgctggtgagctggtgcgtggaggagtttcagcggaagtacggccccggccgcaagccccgcatgagccagattcagaaggagggcttcgtgtggcggcggctgggggtggacacggcccaggccgccgaggcccacctgaagaagcaggccctctaccgcagccgggagggggagattctccgcctgctggatcagccgccccgccccctggtggagaaggagcggaagaaggtggcggcctggacggacatgggctttgccgacgaggtgctccgcctggcctacgaaaagacggtctacaagaagcagaagatggactgggactacatgaacggcattctgtgcggctggcaccggaagaacctgcacaccctggcggaggtggaggcgggcgaccggcagcgccgcccggcggcccagcccgccatgcagggccgccccgccgcccccggcgaggccgaccagcgggtgcgggaggatttggagcggatgcgggagttcctgcgccgccagcaggagacggagggagagtaagccatgggatacgagcagagcgtcctgcgccgggccaccgcccggctggaggcccagcggaaggcccgggaggaggcgcaggagcgcctgcgctccgagatttacgccaagctgccccgggtggcggccatcgaccgggaactgcggcgcaccatcacccagatcatcgccgcctccctgcgggacggcagcgatccggtgcccgccatcggtgtaatccgggataaaaacctgagcctccaggcggagaaggcggcgctgctgaccgagcacggctatcccgccgacgccctggacgacaagcccgcctgccccaagtgcagcgacaccggctgggtgggggccaatatgtgcgcctgccttaaggcgctgtgcaccgaggagcagatcagggagctgtccaagctgctggatctgggggagcagtcctttgactccttctccctggactactactcccccctgccctggccgggggagtccctctccccccgggagaacatggagtttatcttcgacgtgtgctccagctatgcccggaagttcggccggttctacttccgcaacctgttcctcaccggcgcgccggggctgggcaagaccttcctctcggcctgcatcgcccgcaccgtgtcggagagcggcttctccgtggtgtacgacacggcggtaaacatcttcacccgcttcgaggagcagaagttcgcccgggaccggctggaggctggggaggccaaggacgagacccgccgctacctgggctgcgatctgctgattctggacgatctgggcagcgagctttccaccccctttgtccagtccgccctctacaccctcatcaacacccgcctgacggcggacaagcggacggtgatctcctccaacctgaccatggatcaggtgcgcgcccgttataccccccagatcgcctcccgcctggagggagagtaccgcgtgctccccttctatggggaggatatccggctgttgagaaaacagacgctataaaatcaggcagaggagtgtcaacactcctctgcctgattattgcctccgaagcaacttattttgttttaaaagatctcgcaaagataatggcacctgtaataccaagcacaagtgcgattgcacgatacatctgcaatcgctcaaacagctccggtacgtagcggaattccgggaggtacagcgtcgtagctatcagattgccgccggtcaataggatgattccgacaatcctctgtgccagcttctttggatttctgtgtttcattggccaaattcctcaagtcgggatcctaattgtgatgccgcttggataggtacctaaactgtatgttgagctacgtccatctggcaaagtaactaatatctttctgcttattccactatttgtaggaatatagcttacttgatattttagtcctagtctaggtaccatatcaagttcatattgggtaggactttctgtagagggcactcctccatctccaataaacgaccacccaatattaagtgcagtcccaatcgtttcagctcctttcaatagggcccctatttcaattgatacaaattctaatgtggcaaatgtcacagcccaactaattgtcttacccgcattatatttatcaagttccgcctgagtccaaacaaatggtttcgaggtaatttgttttaccaacttactagctactttttcctcatcttcatagaccgttttaattctggaattacctgttgtatagtttgctgttataacatagttaggagagaaatgctttacatccacagtgattgtctttgtaactgtcctattagagctattgtaataagatgcatttttaggtgtttcaatagcgcctgcccgtttgctaggaattaactctaccttatagtacagtgtttggtttgctggaatcttaatagtaaatgagagtttcccgttactaggatttttgatatttgttattaggctcgaatctttaacgtgattaatttgtacccccttttgctccagatcagttaacatttcctgtgacgggtcttcatgcgctggatattcctgctcgacaggcgccactgcggcagccactacagacgaaccgatgctcaataaaatgctaaaggtcaatagatatgcagtaattcttttgattaatttcatattttccccttctttcattgaatgcctcggttgacgtttgccggctaaatcctccctctacgcgcaggctgaggcctctttgtgttttgtgttacaaggaaaaccacgcatattctctgcaagtccgataagaagccgtctgagggggaatctctggaacctcctctcccgcattgccatcgtagtataaccgcacaaaaacttccttacatttcccttaagtttggtttaagattgccagttctcccctcatccgcccctccggggcaccttcccccaggggaaggcagggtgggaacagaaaagccgcccgccccaaagcgcggggcgggcggcgatgatggcgtcctcgtccagcacctcgccccggcccaggctgctcatgtgggactgggcggactccagccccatgagcacgttggccttggactgctcccgggcccggtccaactcggcctgggtgacgccgtgctcggtcggctcccggatcacggccaaaatggtgtccagcgcctgtccctcggtctcccgccccagggcggtgtagacgccgaagtagccggtattgtcatggcaggtgccgtaagagtagatggagtagcaaagccccttctgctcctgcacctgctgaaactcaatcacaacccggacgagacggtggacatcacctggtcggcgctccaataccgtctggatgaatccgtaggctatccaaagattggataaaacgattgcaaacggaggagacggttcacccgtctcctccatttttgtgttcctgttcccattgctccgccaacggctccagcgccgccagcaggtcggcgttcagcgggcggaagcgcagctttccctcataccgcagcccgtcggaacccaggcagaaggtggccgcaggaatccgctcctctgtgtaaatctccagccagaaggggtggtcctccctgtccttcatggggattgagttggagaccccccaccagagcacccaggtatcgtccagaacggtgcgcagctcctccagcccctccccggcggggtcatgggccccgctgccggaaaagagttcatacatgacatagcccgttaccgcctcatccggccccggaaccagccagcccagcttcttggggccgaacaccagcaccaggaccgccagaaccgccacaacgatcagccgtgttctccatctcctcttctccatatcgccatcctcctcccgtgaacccccgttggttttccctcctgttttccacatcctatcacggttttgtggaaacttcaatttaaatccgccctttctcttcccaaggcgtgcaaaaacggaggacggcaaatgatatgtacccagaattctggacacataaaaaattgaattaggtgcacatggatgcctctctgaattttgtaggaggcatccattttgttttctcttggattctttcgttgttgtagtaatttatgtagccgtcaacagccttggcaaatgtttcaaaagaggaatactctttttcatgcccgtagaacatctcgtttttcatccgtccaaagaaggtctccatgatgcaattgtcgtaacagttgcccttccttgacatggattgaatgattttgtgatctttaagtgcctgcctgaagtacacgtgctggtactgccacccttgatcagagtgaaagatcaggccatctacagagggaaacttcgtaaaggcgccggccaacattctctggatctgttccatattggcactttgagataaatcataagaaatgatttcgtttgtgttcatgtcgagtataggagagagataacacttcccccacgaaaaaccgaactgagatacatcggtagtccatttttgcataggagctgtcgtgctgaaatcccggtcaaggatattctcagcaaccttgccgacctcgcccttgtaggaatgatacttttcctttgggcgctttcctgccaaccccatagtgtgcataagccgttgtacccgcttatgattgaccttgtggccgcgctttatcagttcctgatatactcttcgcacaccgtagcggcctttatgctgtgagaaaatgtctttgatttcatctgccaagcaatggtttcgaacagcaacttgatcggccttgctcaactcaaaataataggtagaccgtgccatctgcatagatttcaacagatatttcaattggtatcctttttcacgcagctctttgatgatcgctgctttctcgccttgagttgcgctgcgtgcctctcttctctcaaggcgatctctttttttataacttcattctccgcctttatatactcgttttctgcccgaagccggatcaattcttctcgttcggattcattcagtggccttgcttcttcctttttcatttggggtacccctttacttggacgaccttttttcatttctaccaggccattatacccctttgttttatagttttgaacccattgatacaatagtctatcttgaataccggcctcgattgccactgacacacaggattttccggacattacttgggatactagttccagccgttcttctggtgtccagttcctgttgaaatttttgtgtttcagtgcttctggaccgcggctatcctctgctcttacccatagtctcactttatcccgaaaggatttatcgctaacaccttccggcgtttctggccattttccttctcgatacagttctacacatttccttttgtactcatacgtgtaccgcataataataccccccctactgggtgtccagtaaagggggtacatatcaaaaaggccgtcctccgttttgagcttgatttcagtgcagcagcgcccgataggcgtcggcgctccccacccgccccacggcggagagggaggcgttttcaaaccggaacagctctccggccagggcctgcacgtccgcccgcgtcaccgcgtcgtaggcagcgatgatggcgtcctcgtccagcacctcgccctggagcagctcgccccggcccaagctgctcatgtgggactgggtggactccagccccatgagcacgttggccttggactgctcccgggcccggtcgagctcggcctgggtgacgccgtgctcggtcagctcccggatcacggccaaaatggtgtccagcgcctgtccctcggtctcccgccccagggcggtatagacgccgaagtagccggtatcgtcatggcaggtgccgtaggagtagatggagtagcaaagccccttctgctcccgcacctgctggaacaggcgggaggacatgccgccccccaggatggaggacaggagctggagctggaaccgccgggggtcggcgaaggacaggccggggaaagccagggtcaggtggttctgctcgatggccttcttcttcaccaccaccccgggcacataggcggcggccctcgcagcggtgtggggccgcgcctccaggccggcaaagcgcccggccagttccgcggcgtcggcgtcggtaaagctgcccgccagggccaccacgatgcggtcgggccggtagtgggcgcgctggtacgcccgcagccacgccccgtccatcttgtccagggtggcctttcgtcccaggatgggccgggccaggggggagcccttgaataccgccccggccagccgctcagcgcagagatcctccgggttgtcctcgtacatgccgatctcctccaggatcaccccccgctcggtctccacgtcggcgtcgtcgaaccgggagtggaagaacatgtcgcacaggatgtccgccgcccgggccaggtgggtgtccagcacccgggcatagaagcaggtgcactccttggtggtgaaggcgttgatctggccgcccacggcgtccatctcctccgccaactgggcggcggtgcggctccgggttcccttgaagagcatgtgctcgatgaaatgggccgccccgttctcccccgcgctctcatggcgggagccggtccccacccagatgcccagggaaaccgagcgcacccccggcacatgctccgtcaggatacgcaccccgttggggagcgtctttttttcatacatcaaaccattgtaacctcgcacttctctatattttcgcgcttagtatggacaaataccgtgccgtttacgccccgcgcagggcaatcaggagcagtaccaccgccgtgatggccaggatcagcgccaggtagcccaccaccttctttttcatggccgcgctctcctttcctgttctcgtttgggttacaacactatatcacattccgtcccacttgtcagccggaaaatccgcgggaaaaacagcaggccgggcgggggctctcctccgtccggcctgtatgcagaatgtcctcccgccgggctggactgcccggcttcagcaccaggcggccagcagctccttcagctcctcctgcgtgcggatacagccatcccaaaggccctcatcatccgctgggtatggagaaacccgcagggtgcgcgctccggcccgcaggccggcgtacaggtcgccgtatccctggtcccccacaaacagcatcgcgtcagatggtatcccccagcgggcgctccacccttccatacgtttcggagtggcgtggggcttctccgcgtcaaaaatctgctcgtcaaagcaccccagcagccccagccgggccagaagcgcctctcctccctcccgcctggaatttgagcacagcacaagccggatgccgcggtcccgcaggcggagaagccgcccggccagcaccggatccggttgggggcccaccccgtcggtcagcagatcccgccgggccaactggaaccgctcccagaacgcctcaccgtcccagccgatacgccgggccaggtacatggccaggctccagccgtcggagatataggaccagcatctccggtccagccagggcgaggggtccggacgcaggagtgcagcctcggtgggcacagccagcagcgcggcggccgggccaggacacaccccccattccttgggggcaaaccggccgcagcggaaggccggattgcctcccgccagcacccggctcatctccgcctttacagacccgatctccttctcccatggagtaccggcaaagtagtagtcgatcattcgcaggtagatacggtcgtcgtggtagagcgtgccgtccagatcaaaacagacaagccccggggcagcctgtaaccctcttcccatcagggccgcaccagggcatccaccggatgcccgtccattcctatgggttccagccccagcagacggaggatggtgggcgcgtggtcaatgagcctcccgccgtggattatcctgccggatacagcattgggcccggcaacgatgaaggggggcttgtcccccttccagggcaggtggccgtgggtggagaccgatggcttgtattcctttatgtcgttgacactggtgataagctgctccccatccagggcccttccaaagcacacccggtcgccggcttcaatgacaaagtcaaaatcgccggtcaggtgcatctgcgcggcctcctctttggtaaagatccgctccaggtatttggggtacttcttctgttgctccagcaggacgcaatacaccatttcccggtccacctccggccggagatagatgtgtgcgctgagcgaacagttggcggcatagacctgatagtctgccagggaaccgtcctccgcggtctggagccagcccagccggtggaacagggcgttcagatggaacatctcgtcgcagtagagctgaccgtggtcgcccagcagcacaatatttgtgttctccacgccgccggtctcctccagcgcatccagcacaagccccatctgtccgtcaataaagcggaaggcgtgctccagatctccgtgcacgcccaggcggtggcgctggtggtcaacgtaggacaggtggagcagcatcaggtcggggcggtgggcccggatgatgtcggcggcgcacttggcggcgaactcgtccatctgtggcgtcttcatccagcggagcatgtgcttattggcctcaaaaatcttcgccaccgcagggctgttggccctggtaaaccacggtgtcgggtcatcctcctcctgcggggcccagatctcgccaatattgtactccgctcctgaggcgcacatgacgggccaggtgacggtagaggcagtcagccccgcctgtcttgcaaaatccaccacggtaggcacctgaatggcctcccgccaccaataccagtccatccgtccctttgcaaaaaaatctggaatctcattattgttgatgccagtccggtccggccagcagccggtggcgatggtggcatggcagggataggttaaggtgggatagatacattcgatatccgtaatccaggaggcatgctccatcacgcgccccaggttgggaagctgcttcagcacggggatatccgctgtgatcagcgcatcaatggagaccactagggtgcgatttgtcatggggtccttcctttcttaagtacggtcctgttgggcctcttcctctttcatcagcgcaacgagctcccgctcccagcgctcggtctcctccagctcctccgctgtagcccggacccccggccggacacaggcggcctcggccaggaagtggtcgatgttccgcccccgctcctggccggtcagcgtgtgcatgtcatacacataatcaggcaggggaaaggggtctccccgccgtatgcgccgcttaaccacactggcaagcacgctggagccccgctccttccggcaggcgcacagatagcgcaccgcgtggacgaagagcagttgataatcggagctgtcccgggagagctcccggctgctgcggtgaagggcgtccaccaccactggggccatgggctcccccaggcccacgtcctcggcactgatcaccagcaaccgtctccacaggtaggcggtcagctcctccccggtcaggtagagctcataggcagcccgcaccgccagctccgtctccccccggcggataaatttctggagggcggatatgacctcgtcccccgggtgtccgctgggagttacgatgtcatggtaaaaaattggtatcatgtcaggtttcctttctgcgcgcccgggccgggacacgggaccgcggcagggcggaggcggatgctccgtctccgccctgcccaagtccgcttcagttggcgccgacggtctgcttcaggttggccagggccagctccggctccatgccgttgtcggccacctcctgcatcatggtcttgacggcgctgttgacggcgctggaggtggtggtagcattggtaaacacgggctcatagaaatagcggtcactctgctctacaccggcccgcatgtactcgtggccgtcggccacataggcctcataggccggatcctccgccacggactggcgtatgggcagatagccggtgtttccggcagctaccgccaggttggcgtcatgggaggtcataaacttgataaattcataggccgcatacattctgtcctgattcccgtcctgattcaaggcgataatgacatggccggcggacaggttggcggcggtatcctcgctcacctgaggaacaggggcggttccccagtccagctcgggatttttgtctgggatatagctggcctccacgctgtcgccgatatacatggggatcatctcattggcaaagggcccggagaagaactgatcctcccccgcagtacgccagataccctcattcacgttatcctgccacatctgaagcaccttcagggtaatgtcgctgtcctcggtggcaaagtacagattgccgttctggtcggtgtagcggccgccgttttggagcagcagggtcataaagctacctgccaggttgtcccagccaaaggcgggcgcgccggtaatgtctcggatggcgcggcaggtttccaccagctcgtcccaggtggtgggaacactgagtccgtgctcggcaaaaaacgtcttgttgtaatagagcacctcggagtaggagtggatcggcagggaatagataccctccttggcatagctggagttcgcctcccgcagcccttcaaagatgtcctcgtagtcggtcatgcccacattgggatctgtaatatagggctccaggttaaccacatagtcggtctggaggtagtcagccacataggggcgcagggccagggtcacatcaggggcgctgcccgccttgatcgcgcccaccacgctggaatagagctcactgctgctgccgttaaaggttgggaccacggtaatacccttctcggcacctatcgtttcattgaactcctccaccagcccctccagaaccttcaggtggttctgattggagatggagtgccagaactggagttccacagggccggaaagggtacccagttccccggcgggggtttcggccccgctgggggccggtttgctgccgcaggccgccagggaaaggcccagggccagggcaaggcttacgctgatgagcttccgtttcatcgaaaattcctccttcttttctttcgtgccatatgctttcattgtgttattcaaagcccggcaggccgggcaggatcttaacccttgatgccgccccgcgccacgccggcgatgatctgctttcggaagaccaggaagaaaatcagcatgggtacaatgacgatcgtagcgccggccatctgcagatttacctgggagctcaccgcatcccggaagtggagcagaccgatgggcataacccggtgggcatcgctcttggtgaccataaggggccagacaaaggaattccattggctgataaaggccagaattccaatggtagcaatggcattcttgttcatggggatcatgactttccagaggtagcgccagtcgctgcagccgtccaccttggccgctttgtagaggatggaggggatctgcataaaatactcccgcatcatatagatatagaaaccgctggccaccgttggcagaataatgccctgaaaggtgtccatccagcccagcttggagatcgtgatgaagttctggatgatgagcagctctgcggggatcatcatggtggacaggcaaagcagaaacagcagctttttgccccgaaattcgtaaatggtaaagccgtaggcagacagcacggtaagcaccagggtaaggagggtaccgccgcccgccacaataatggagttgcgcaaataaaggccaaagggggcgacggcaagagcctccgtgtaattttcaaactggggcaccgcagggaacagggttggcgggatggagatggactccggcagtgttttcagggaggtaaagagcatccacaaaaacgggaagatcatgacaaaggctccaacagtcagaacggcgatcttgaccgccttgcccacgttctgtttcatatccgaccctcccttatacatagtatacaaaccgcttggagacccacttctgaatcaccgtcagggccagtacgatggccagaaagatgatggccgccgccgaggcgtagtgaacctgtccccggttgaaaaacatgtcataaatatagtagaccatagtgatggcgctgtttccaggcccagcgctctcccggctgaacatagcatagacctcgttgtaggtcttaaaggcatgaatgaccgaaacgatggtgaccatccaaaacgtgggggagagcaggggcatggtgatgcggaagaatatccggtgcgctggagtgccgtcgattcgggcggccttgtagtactgctggtcgatcttttgcaatccggccaggaacaggacaatcttaaacgccataccgctccagatggtaaaaatggtcaccgccacaatggtcaggttgggatcggacagccacttctgtggctccagccccaaaaactccagaaaaaagttgatgtagccgtattccgagtggaagagccagcggaacaccaggccgatggccagggtggaggtgacataagggagaaaatagagtgtctgaaacagtcccttggtccgaagcagggaattgatgagcagggctgcccccagggagagcacaatcgtgataggtacgcccaccagaacaataaacatggtgttgcgcacggccagcccgaaagcgggatcctgaagcacgtaccggaacgaattgaggccgaatcccgtgccggtgtcggtaaggtacacgtaactctggtaaaaccccatccgaagcgtcatgaggatggggtagaccacaaagaccgccaaaaccgcaaaggcagggagcagatacagatatgccttggcgctgcgccgggtgttgcccagcggattttctgcgcgggccggcttggggctcctcatcccgccacctccgcatccagccgtgcgccggtctccgggtcaaagatatagaccaggcgaggctccagggtcagctccacggcgtcgcctgccgccacaccggcggtgatgtccagaatggcgcgggcccgctcccctgccagtgagaaggtaaccagcagatccttgccccgcatctccacagcctcagccgcagtccgaagcccctgccccagacgccacgcctcaggccggatgcccaccaggaccggcccatccgccgcgccgcgcacccggagcatgtagtcctctgccagacacaccgttccgccgcacacgtccaaccgaaagaaattgatggggggattccccagaaagcctgccacaaagcggttggcgggattcaaatacatctgttggggtggacactgctgctgcaccacgccggtcctcatcagcacgatctcatctgtgatactcatggcctcctcttgatcatgggtgacgaacacggtggtgacgcccgtctcagtctggatgcggcgaatctcttcccgcatctccaatcgcaggcgggcgtccagattggaaaggggttcgtccagcaagaggatatcaggccgcttgaccagcgcccgtgcaatggccacccgctgctgctggccgccggagagctggcccggcttgcgcttgaggagatcctcgatctgcaccagtctggccatctccagggtacggcggcggatctcctccttcccctccttgtggttgaccagagggaatgcgatgttttgctccaccgtcagatggggatagagggcatagttctgaaacaccagaccaatgccccgcttttctgggggcagggccgtcacatccctgtctccaaagaaaatccttccggaagtaggcgactccagccctgagatgaggtagagtgtcgtggactttccgcagccgctggggcccagcaatccggtcagcttgccgtcctgaatcgtaatgctgacatcattcaccgccttggtttcggaaaaatccttgaccagatgctccaatcgcagttccatggcgcagctcctttcatttattttgctttttattgtctccattgtattctatatcatttttcttgtcaataaaggttcaaaattgcagtttttggtctgttttttaagctttaatttcatataatctctttatttgatagtatattatcaataatcttctctgaaagagataaaaggcgttgaattatcattttttaaaatttggctttacaaaaaatgtacagaatatccaactaatttttgctttattcttgccagagatccggttttatgatattctctccctagtatttaattaagtatgggaggattgcaccatatgagtctcaaaaagatgacacgtattgataaaatctcccagcttttgatcgccaagacgggcgtatcgattcgcgaactggcggtggagctgggggtatctgaaattacaatccgccgggatctgaagcagctcgagcagcaggggacggtaaagctgatcaacggcgtggccattcatcgcgccgcccagaacccccacagcacccttcccgagtacaatctggattacgaggttctccactttggagaccggaaggcccgcatcggcaaaaaagccgcctccctcattgaacccaacgatgtcattgccattgataccggctcaacctgctcctacctcacacaaaatctgcccagcggcgtccacctgaccgtgctcacctactgcatgaacaccctggcccagttgaccacgcatccgaactacgacgtgatctgcgcgggcggctacctctatcccaacacccggatgttttatagtccagagggtatcagccttattaaccgcacctgtgtaaacaaggccttcctctccaccgccggcatcagtggcaagctgaacgtcacctgtgtggctccccatgagatgaacgccaagagcgccctgatggagagcagccagaccaagatcctgctgctggactcctccaagttcagcaaaatctgtcccacgactttcgcctacctctccgattttgacatcatcgttacggatgacgagctctcagccgaatggcagggctatattgccgacctgggcattcagcttttgctggcctgagcgggcagccgcatcatttgcatgaacccccatgcgtacaggacgcgccgcgaaactatgcaaaggcttaggcgcatgaagtgttcgcgcatgtgggccgtaccggcctacgcgctgtcatcttatggccgtgccgctgcaagcggcgcatgggcaagtttgctatgctcttgcagagcaaaagggccggacggaataatccgtccggccctttttatgccgtatgcgctctttacttgatgggctcgccggcctctttcttggccttgatctccttcagggcgtccttgtaggagaggttgacgcggcccttctcgtcgatatcggtgaccttgacccagatcatgtcgccgatgttgaccacgtcctccaccttctccacccggcggtcggccagcttggagatgtgcaccatgccgtccttgccgggggccagctcgacgaaggcgccgaactggaggatgcggaccaccttgccgtagtagagctggcccacctcgggcacaaacacgatggtctcgatggtcttcttggcggcgtcgcaggaggccttgtcggtgcccgcgatatagatggtgccgtcgtcctcgatgtcgatcttggcgccggtgtcggcacagatcttctggatgaccttgccgccggagccgatgacctcgcggatcttgtccacgtcgatcttcatcttcaccatcttgggggcggtgtcggccacgtcggggcggggcttggagatgcaggggagcatgatctcgtccaggatggcatagcgggcgtcgcgggtgatctccagggcctccttgatgatctcgtgggacaggccgtcgttcttgatgtccatctggatggcggtgataccggccttggtgccggccaccttgaagtccatctcgccgtggaagtcctccacgccctggatgtcgatgaaggtggtgaagccgccgtcgtcgtcctggatcaggccgcaggagatgccggccacgggggcggagatgggcacgccggcgtccatcagggccagggtggagccgcagatggagccctgggaggtggagccgttggaggagagcacctcgctcaccacgcggatggcgtaggggaagtcctccacggaggggatcaccggctccagggcgcgctcggccagggcgccgtggcccttctcgcggcggttggtggagcgggcggcccgggcctcgccggtggagtaggcggggaagttgtagtggtgcatataccgcttctcctcctcctcccagatggtgtccagcttctgggcggcggagagggtgttcagggtgcagacggagagcacctgggtctggccgcgggtgaacaggccggagccgtggacgcggggcagcacgcccacctcggcggccaggggacggatctcgttcttggcgcggccgtccacccggtggccctccagcagccaggccttgacgatcttcttctggaacttgtaggtgatctcctccaggtacttgtccatctcgggatagtcctccaggaagagctcatgccagtgctcgatgagcttgttccaccgctcctcgcgcacgttcttgtcgtcggtgtccatggcggcgcgggcctcatccatggtggcctccacgatcttgtcgaacagctcctggtcgaagtcggcgtggtcgtaggtcatcttgtcccggccgatctcggccacgatctggttgatgaaggccacctgcttcttgatgtcctcgtgggcggccacgatggcgtcgtacatgatgtcgtcgggcagctccttggcgccggcctcaatcatgatcaccttcttgtcggtggcggccacggtcagatcgagctgggaggcgtgcttctgctcgttggtggggttgaggacaatctggccgtccacatagcccacctccaggcaaccgatggggccggcccaggggatgcaggagtaggccaggcaggcggacacgccgatcatggcggtcacctcgggggagcagtcccggtccacgctcatgacggtggcggtgaccaccacgtcgttgcggaagtcgtaggggaacagggggcggatggagcggtcgatcacgcggcttgccagcacggcgggcagagagggctggccctcccggcgcatgaaggagccgggaatgcggcccacggcgtacagcttctcctcaaagtccacggagagggggaagaagtccacgccgtcccgggggcggggggacacggtgacggccaccagcacggtggtctcgccgtaggtgaccatggcggaagcggtggccagctcggccaccttgcccacgtcgatggtcagggggcggcccgccacctcggtcttgtagaccttgtggttggtgaattccttgtgcttgataatggttgacatgcgggtattcctccttttcattggtgtctcccacacatcagagcccgatcccttttagcacttgaagccgggtccggtcctccgggcccaggttcaactgctaaaaagcaagctccgacggatgggaagaaggggtggcacggagtccgcgccacccctcttgattcgttgttgtcacgctgcggcggctgcacgacggacaactgctcaacactccgcgaaaaatgccgttggcgttccgccaacctgttttttcgtctgcgtgtttcgctgtcgtcctgctccgcacgcctccgcgcttcttcttactttcggatgccgagcttggcgataatggcgcggtagcgctcgatgtccttggccatcagatagtccagcatcttgcggcgcttaccgaccatcttgagcaggccgcggcggctgtggttgtcgtggatgtgcaccttcaggtgctcggtcagctcctggatgcgggcggtcagaatggcgatctgcacctcgggggagccggtgtcagtggcgtgggtacggttggcctcgatcacggccgtcttctcgtccttacggatcatggttgggttccacctttcatacaatgtgccctgggctgcgtgaccggccggtgagagcctggggacgaagccgggggtaaattctgcctgtaaattacaggctgtagtagtttatcatattctccccgccttgtaaagaggtcattcccgattttgcggcgaattttcccgcgccgccgccgtcctctggcgccggcgcaggcgcgggggtatgatacaaaaaacagcaaggaggaatggttatgatccgtctgctgaccgggagcacgcacacgggaaagaccctgctggcccagcgcctgctggagcggcacggcgcgccctatctgtccatcgaccacctgaagatgggcctcatccgcagcgggatgtgtcccctgacgccggagagcaccgacgaggccctcaccgccgtcctctggcccgtggtgcgggagatcgtcaaaaccgcggtggaaaacggccagtcgctgacggtggagggttgctacatccccttcaactggcgggaggactttgatgcgtcctgcctcccccacatacgctttctctgtctggtgttcagtgaggcgtacatccgcacccggtttgacaccattcagacccacgccaacgccatagagcggcggaaggacgactccttctgcaccatggaattacttttggcggaaaaccggcgcaatctggaggcctgccgccgccgcggactgccctattacctcattgacggcccctatgccccgcccctggactggtgagcgttaccaaatcgtcatttattcttaataaattatctttaaatccccattgacaatcatatgattatttagtataatcatgtcaaagcaagaaaaggagtggatgatatggcaaagacgctgccgggaaccaccatcgcggtggactggaaccgaccggaggaggcggagaccctgctgaactccctctttttggccggggggctgatgctctcccaggtggccagcctgaccgggctggagccctatgtcatccagaactgggtccgccggggctttgtggccccgccggagcgcaagcggtactcccgccgccagttttcccgcatcgtcctgatcaatatgctgaaggattccatgcagctggacaaaatctgcgccctgctctcctatgtcaacggggagctggacgatgaatcggacgatctgattgacgatttccagttgtatctctatattgtacgcctggcggccctggtggagcatcagcctcccagcgggccggacgaggcggcccgctggtgccagacagcggcggagagctaccgtgagagcgtcccgggcgcccgggaccgggtggcccgctgcctccatgtgatcctgacggcctatctggccggacggctcaagcaggaggcggaggccctcctcgcggccctggcctgacgcgtcccaagacagcggtagggacgcggagtatcccaccgctgttttatgatagatcgcatccccatttcgagaaaggaggaacccattcatggcagcctggtggcaatccctctctgccctggaccacgttctgctctacatcgccgtacccgccacgctgatcctgctgattcagaccgttctcctctttgcggggggcgcgtttgacagcgacggcgacgccggtgtgccggacgcggacgggccggacttcgacggccccgacgccgacggcggcccgctccacgaggccgcggcggacccggagacccccgacaccggcctgcacctgttcaccgtgcggggcgtggtggccttcctggtgctcttcggctggggcggcctgtggctccaccaggtaggcctgcccggtttcctggcggtcttcctggccatccccatcggctttgccggcatggtgggcatcgccctggccgtccgccaggcccttcgcctccagtacgacggcaccctggatctccgcaacgccctcgggcggacgggcaccgtgtacctcaccgttccccccggccgctcctcccccggcaaggtcaccctcaccgtgcaggagcagctgacggaatttgaggccctcaccgactcccccgcccccatccccaccggcagccctgtccgtgtcaccggtctggccggccgcggcgccctgctggtggaacccatcccatccgaatcaaaagagacagaataaggaggaacttatgccaaacatctttggacttatccttacctgcgtcatcgtcgtcatcgtcttctccctgctgctgttcctgatcaagcgctacaagaagtgcccctcggacaaggtcatggtcatctacggcaaggtgggcagcaacaaggacggctccacccgcagtgccaagtgcatccacggcggcgcggcctttatctggccggtcatccagtcctatgagttcctggatctgacccccatgtccatctcggtggatctggaaaacgccctgtcccgccagaacatccgcatcaacgtccccagccgcttcaccgtgggcgtctccaccgagccgggggtcatgcagaacgccgccgagcgcctgctgggcctgaagctccaggagatccaggagctggccaaggacatcatcttcggccagctccgcctggtcatcgccactatggacatcgaggagatcaacaccgaccgggataagttcctggaggccgtctcccgcaacgtggagggcgagctcaagaagatcggcctgcgcctcatcaacgtcaacgtcaccgacatctccgacgagtccggctacattgacgccctgggcaaggaggccgccgccaaggccatcaacgacgcaaagaagaacgtggccgagaaggaccgcgacggctccatcggcgaggcccaggcccgccgcgaccagcgcatccaggtggcccaggccgacgcctccgccatccagggcgagaactcctccaaggtggaggtggccatgtccaacgcccagcgccgcgagaaggaggccgaggccacccgcatcgccaccgccgccgagaagatcgccgcagcccaggccctggaggaggcctacgccgccgagcagaaggccgaggctgcccgcgcccagcgtgagaaggccacccaagaggccgatgtcatcgtcaagaccgagatcgacaagcgccgccgggagctggaggcggaggccgaggccgagcagatccgccgccgcgccaagggcgaggccgacgccatcctggccaagatgcaggccgaggcccagggcgcccaggagatcctggtcaaacaggccgacggcctgcggcagatcgtggccgccgcgggcggcgacgccgaccacgccgtgcgcctgatgctggccgacaagatggaggagctcatgcgcatccaggtagacgccgtcaagggcatcaagatcgacaaggtcaccgtctgggacggcggcgagcagaaggatggcaagaccgccacggcgggctttgtctccggcctgatgaagtccatcccgcccatgaacgagatgttcgacatggcgggcatggagctgccccgcttcctgggcaagaacaaggaggagcctgctgctccccccgcgcccgcagaagagtccggcgcgcccgcagaagagtcctgataattggaaggcccccggaacctgatgggttccgggggcctttctgctttaaattagagcttcttttcggcaaagcgcatgaggatgacggccacctcggcgcgggtggcggtgccggcggggtcgagccggccgccgtcctttccggtcagcagaccctcgcccacggcccagcacagggcgtccgccgcataaccgctggccgcgtccttgtcggcaaagccgtccaggccgcctgtgggctccggtgcgcccgcatagcggtacagcatggccgctaattgctcccgggtcaccgcgtcctccggaccgaaggccccggtgtcatacccggccacaatcccctgggccgccgcccagttcaccgcgccggcataccacgcgtccgccgccacgtcggtgaagcccgccccgccgggggcggcagggctgcccgccaggttccagagcacctgcgccgtcatggcgcgggtcagcactgcgccgggggcgaaggtgacggcgctggtgccgtccatgaggcccttttcatacacataggccaccgcatcatagtaccactcgccgctgctcacgtcggtgaagggcagggatttgggctgttccggctcggtttcgatcgcggtgaagaccgcctcgacctccaccttggaagcgggcattttgaaggtatatttgccgtcgcccttgtcggtgagcttgatggaatcgccatccttgccggtgacggtcagcttgtccagctcatagccctcgtcgggcttcacggtgatggtcacggtggtgcctctggaggcgcgggtggggcttaccttcacgctgccgttgtccgtgtcctccacgctcaccgtgtaccgggtggagctggaggaggagccgccggaggagctgtttttggagaacgtcgcatggacgatgcagtcctttgtcacattctgaacggtgtaggtgccgttatcgttctgcaccacggctgcggcggtgctgtcatcgacggtcacatcagagatggaatatccgctgtcggcggtgacggtgaaggtctgactgccgccattggctacggccaccctgccgctgggagtgatggcgccgccttcgccggcggtggcggtgatggtaaagccctgcgcggggtctgttgttccatcacctaccaccgcactgccaatgtccgtagtaatatccctggccgagtcatctgtgtaggccagtttgatcttcagctgcttgtcttctttggtagtcttgttgtccgcaatggtaacagggaaggagccggtatcatttccgtccttttcgcccgtctttgttgttaccccaagaacaatatcgccgcccaaaattggattcgaattgttaaaagtacaaccggaaatagtcagggacttgacactggcccgcgcgccggtgatatcatcggcttcagtcccgtcacccgtgccgcgttcagcgactttaatggggccggaagcaccgcaatttccttcaaacctagtgttggtgatcgagatcatggcatcctgtacggcgaccaggttcaggtcgatggcatagttaatgccgccgcagtttgtaaaggtgcagccgtcaatagtcaggtttttcgcgttggtcagatacatgccctgtccaccgctcactcctgccttggagttttgcacggtgcagttggtcatagtcaggttcagaccgctgacaacagttgcgctctgattctgagaggtaatgaggatggatttatccgccgttccatctctgttggtgtcgccgtccacggtcagattattcaaggtgaggttcgtgttggtctggttggcatcgtcgcccgaagctgccacacagttgatggcgccgtacagggtcttgccgctgccctcaatggtgagggtgctgcccgctgtgatggaaatgtcttttgtcacatcctgcagcagggtgagggtgtgatcttctgcggccagcgcggcggtcagagcattatcaaaagaggtgaatttctcctccccaacctgtgccacaaggacgccttcttgcgtcttttcaaaggtgtccccaggggccagcgtgatggtggggatgtccgcatccttggccgcctgataggccagctcaaccgcaacctcgctgccattttcggccttcacattggagatggtcaccgggaacgcgccggtggagggcgcggcggcattgttctctcccttcccctgggaacccagttgaatcttggccccctcggagaaggtgcagtccgcaaccacagcggaggcaatggtggcgggttttacttctccgtctcccgacggcttcacatctgttgccacgtcgtcctcgccgttgcgctggttcagcttgatggcattcttctcatagctgcccgtaaaggtacagccccggatctccaccgtggaaccctggatgccgcagaggttccagttgattccgtacttcaggccgtcctctccggcgttgaaggtgcagcctttaatcaccagagactggcagttgggcaaatacataaacgaggagtttgtcttgtctccggcggtattgccggtaaaggtacagtccgtcagggtcaggtgcagtctggggggattggggcgcgtctgcacattggtcagggcaaactgtccctccttaaactccgttctgctgatagtcaggtatacgtccttaccgtcgagagcgtcgcccttcaccgcctcattataggcggctaccgtagtgaagggctcctcctgcgtgccctttccctcctctgtgggcacgggctcctgtggctcgtcgccgggctccgtcctggcgtccgcgcttgtttcctccgtctgttccattccggcgatgggaaggggctgctccgcgtccgccgcaaaggcggacggcatcagcgtcagcagcatgcacgccgtcaggcacaccgacaagatgcgtttctccatgattctgttttcctcctttttgatgtcaggggtcgtggccgcagaaaatgtgtgtcaataccactccgccgtaccggaggttcccgcaggatgccattcggactgcatacaaaacagcttaaaacaggaagcgcgggtctccggccaggtgaaacagcattggccggcaaaccacccccttttggaaaagtgtaccttttaaaatggtggaaatgcaggataatctatgttaaaatgtaattgatatcgccgtatttctgtgctatacttcacactaggtagtgcgactatttcatttgtaaacgtacactttttcaaacaaacaaagcgcctctggaatattccagaggcgctttttgcatatagttccgttacagcagggtgaaatccagcagctcgtggccccacgcccgctcgggggcgtccagcccgcggccgtccaccatcagctcgccgcactggttgtcgtaggggtcttgccgccaggcgggcatggggggcgtcaggggggcctggaaggcggaattggctaccatccgccaggggtccaggctgccgaagtagtgggcccggcgggcgtcctccccgctgcggcgggcggaggagccgaaggagcagtccgcccacagccagccgtggggggccaggtagaacatggcccagtcgtgggggcccacccggccgggccggacggccagcccgctctgccaccgggcggggatgcccgcgatacggcacagggtgatgaagagcagggcgaacaccccgcagtccccccggagggtcttggcgcactggtcggcgatgcagtccagctggaggtaggcgggctgatagcggtagtccacctgtccggtgacgtagtcgtagatggccttcgccttttccgccgggttggcgcacccctcggtcagccgggccgccagcgcccgcaggtagggggtaaagacgatgtggggcggctgctcctccaggtcaaagtccggctgcgccagctccagagagagggacatgggagccgtgtactccgcccggaagaggtaacggtaggtgacggagaactcccccacgccgtttgttttccaccacatggtgcgctgtggtgcatactccggcgcggccaccccgccgggggtgcagtccagcagctcaatattgctctgctgggggcaggccgccgggaggggcagccacgcctgcacctcctggcccgcaacaggcaccagcgcccggatatccgccttcagggtaatgcgggcggtgagggagccttcccgctccatccgggccagcacggcatcccgctccgcgttgtccaccgcctcgtggacaagccccggtgcctccttcgggtagatgcgcagggactccaggaactcccggtgtacccgcagctccccgtccaccatccgccagtcgatgcgcccgccgtccagcagggcgtcgaactgcgcctcggtaaagccgggccactccgcccgtaccagggccaccgcctcggggcgggtgtaggggtagtcgtagggcaggcgggtcagccgcagccgctccgcctccagccggggggccagcaggggctggacgccggaggagagccgggcgtcgatcagccggagcgcccccgccagatcccccatatccctgcggcgggcgatgtcggcgggcagggcgtcgttcaggtggagaaaggcctcattctggttgtgcataaatatccccctttgcgtttcctgtccccagcatagcacaaaccggcgggcaaaacaaccgtgccgggacagcgctgctgtcccggcacggttgatcggtgaggttattcggcggtgaagatggcctcggcccgcaccagcagagcggccagctcggcccgggtggcagtgccctgggggttcagggtgcccgcgccggtgccggtgagcagcccggcgtccaccgcccaggccacggcgtcctgtgcgaaggcggacacggcggaggcgtcggggtagccggacaggtcggcggccgcgctcacgtccaggccctgggcctcggcgtagttgcacaacagggtgacggcctgctcccgggtcagggcgctgttgggggcgaagccggtgctgctggcgccggaggtgattccggcctcataggcccaatccacggcagcggcgcagtaggagccggcggccacgtcggcaaagccggcagaggcggaggcggcgggctcgcccgccatgcggtggaggacggtgaccagcatgccccgggtggtagtcacgtcagggccaaaggccttggaggtgacgccgttcatcaggccctgcccggtgacggcggccacggcctcggcgtaccaggcgttgggggccacgtcggagtagccggtgtcgttcagcacggcggcccaggcggcgttggagatgaagttgtactcatcccgctggttggtcttgttggtcagggtgttggcgaagagcaccacgtccagttgggcgttgtccgcgcccgcgccctggtaggagatggcctggatggagtcgtccaggaagtcgtcgaagtgctcgccgtcggcggggaggaagccctccagcagctccttggagccgtccagctgcaccagcacctgggcgccggcggggatggcggcgaagtagccggcgccgtagccgtagaggaggtcgtcgccctcggccacatagctggcggtgatcaggctgtcggtggggtaggtgacgtaggccagggcgtccatggcgttggggctgacggtctcccgcaccagcgcgccctcgtcaaagagggagacggcggacttcatggccttggagccgtagccgatgtagggggtgccgctcttgacggcggccagggcctgctcgtccagggcggccgcgccgatgatcaggtcggcctgggaggcgtcgtcggtgacggtgaagcccagggtgcgcatggcctgccggtcgtagttgtactcgtaggaaccgctgacaagggtggtcttgacgaagcccttgtcgttgtcggcgggcttgccggagatgtagaccacgggggccttggggatggccagggccgcgggggcgtcggtcacgcccacgccggagagcaggtagtcgcccgccacgctctgccagtcggcgtaggacaccaggaagctgccctcgtactggccctcggtgatgagggagacggacttgccggccttcagcagggcgttgacggcggcggtggagtcctcggaggcgttcatgagcaccacctgggcgtccttcacgccggagaaggaggaggtcagggaggccacgtaatccagggtctcctcatagtccaggacgtcgccgcaggcggcggagatggtcttataggcggcgggctcggcgcacaccaccatgtcgaagccccgcaccttgtcgaaggcggtgatgccctcggagtagagaacgggccagccggtaatcacggtgccgtcgtacagcacgccgttggccacgctccgcttggcctggtacatggacacgatcagggtgccggcggggtactccacgccgttgtaggtgaagctctggtcggtgaggctgacctggacgccgttgcgggtcaggtactccatcatctcggcggcggcctggaggttggactggttggcgccgtccatgggaatgatatagcactcggggtagaagttgccgttctggccctccccgtcgtactcaggccggaagaggtcggcctccgcgccctccacgtcgtactggtcgcagaaccactggcccaccagctcgtaggcatcggagttggcgttggtcacgccccgctcgaagatcttggtctggttggtcaggtagccgtccttgtgctcggcgatgtagacggactggcccagctggccgtaggcgacgccctgcaccatgtagtcgtcataggcgggcacctccacggtgtaggagacggtgccgtggagcatggcgtactggggggtgtagctggtggacatgtcgtcccaggggtcgagccactgggtctggtcgtccccgtcggcagtcttcgcaccggtgtaggtcaggtagtcccgctgggggatgacgtagctgttgtggccgccgttgttggccaccgcggcgatgcccagggcctcgccgccgcccatcaggtgctcggccagcagatcgtactcgaagttgggctcgtgggggggatcgcagggctcgcactggaaggcctgcacccggccgtggaactcggtgaggctgacagggttccactcggcgatcagcttggccatgttctgggtctcggcctgggtctggaaggagttgtcccggttgaggtcaaagccgccggaggaggtacgggtcaggtaggtccggccctccacgttctcctcggggacgatgatgaagaacacgtcggagagcagctcgtccacgtccaccgtcacagtgtcaatggtgtagtatttctccagctccacctgggtggagatggaggcggtggtgccgtcggcgttctcgcctttgatgtagcccaggtaggtggcgtcatcggccaccaggtcggggacggccacggagccctcctcacccgcagggcccatctgctcggccagctcggccttaccggcggcggtgaagccggtgagcttgtcgtagtcgatggtgccgctctcagaggccgcggtctccaccagcatccaggcaaaggccaggatgccgtcgctggcggccacctcattggcgtgaatattggagtacatgacgggcacttggtagtcgcccagggcgccgctctccagcttcttcagcagggcggtggggtcgctctccgcctccgccttgatctcctgccacttgtccaccgcggccttgtccttggccacaatcagataaggcatatccaggctttccaggccgttgtcgccctggctctggcccatggagaactgctccacgtagaggtcggtgtggccggcggcgtagtccaccagcgcgtccagctcgtcatagatctccgacatggtgtggaagttgtcgtagggtgccaccttcagatccacagagcccagggtcttgccgtccagcccggcggacagcgtgaagtagccgcacacatccatataggagccgccgttgctgtggggcacactgagatcgtcaccgaagtagcactggttggcgaaggtgacggtcaggtacacctggccgtccaccgtctcggcggcggtggccacgtcggtaaagaagggggtctcgccgtcctggcacagccaggcgctcaggggaccgccctcggtctggttgggaaactgggtatcgtccaagtaatccggcgcgtccgcatcgggcgtcagggtccaggtcacggaggaggcggcctccttggcctcggcctcggtcatgtccaccgggatgctggcctggaaggtccgctcggcggacagggagatgccgttgctcccgccgtcaccgctggtgttctcaaacacagcggcgggggccgctgcgctgtctgcggccgcagacgggatgacgcacagggacaggagcagcgccgatgccgtcagcatggacagcgcgttgccgagtgttttgtgcttcttcatgctcttcaccttactctttcctcttacagtgtataatattcgtatgttttcgaatatttatgtataaaagataccactgcaagccccatttgtcaagcataaatatgcataaccaggcggctttcttctcccttttcctttggataaaccgctgttttacggtccaatctcatatcctttccaacacaggcctatttttctgtaattttatacacagcgtcttttaccctgtctgtgccggcacgcaggaataaaaaatgcgcgggagctgtatctgctcccgcgcacggcgctccggcggcccatccggttacccgggcatgggcacctcaaattccggctggcccatgtagccgggggcaatctcatacttctcaaaaatcaataccggattgcccgcctcattgatataaaagcgctggtcatcggcgatggaggtgaagccctccaccccctcctccccgtggaagtagatgttgtcggggctctccgcctcctgggcggcgatgcccgcccgcacggcctcgttggccagttccttatagtccggccccagcatatcccggagggtgagctcccgcccggcctggaggtcaatgttataggtataaagctcggtgtatgcattggcccgggtttccgtctcggtgagcacaaaagacagataatggtcgttctgacacttgatctcgtagtcaacatcgatcatgacggggatgaagtcctcctccgcaccgccggtggccacataggcgtcgcggatggcccgcgcccggtcctcggcctcctgaagcacctggtcgatgcgggtctgaatggccaggttaatgcgctgctccaggtcggtgtccccgggcagctccagggcgggcaggcgcacgtcgataaggcgctcccgctcgtcgatgtggtactccgtgacggtgaccacccgggccagaccgcccagcaccggcacgtcggacaccgcccgggcaaaggccggactggcgttgaccagcagcacaaagcaggcgcagcccgccagcaccccgctcacgctccggcgaagcgcccggcggccccgcagccgccgctggcccgcccgcaaggcagaggctacggcaaattccagctcctccggcaccggcgtgctctcatggcgcaccctggcccgttcccacatatccggcatatcagcactcctcctctgtcagctcccgcagacggcgcaggctcttatagagcctggatttcacggtgttcaagttggtgttggtcacccgcgcaatctcctccagcttcatgtcctcgaaaaagcgcagtcgcaccacggtctgctccttccagtccaggcgctcgatggcgtcatagagatccagcctctccccggggtcccgggcgggcgccggggtctccagcagggtgtcctccaggggtaccagccgtttggcgcggcggtggtgattcatactctcgttgagcaggatgcggtaaaaccaggctttgagatactccggcctgcgcaatgtatccgacttggccagagccttgacaatgctctcctgcaccacgtccagcgccgcatcccggtttttgacatagctgtacgccaggcggtaaaattcctcctggtgagccacaatatagtcgctcaactgctggcggacagtctgttccaaggtccgggcgctccttcctgcttctgttgcttagacgcggcaccagcccaaaaagtttgaaaaaaagtgccggtacccggcacttttttggggggaacgcaggttactccagcccgtccagggcggcccgggccttttcagcatcggcggccacggccagcaggacggagttgccccgctgctccacaatggcgctgtccagcttggagacctcgtcgggctggtagctctccagcacagccttctggtcggctaccctagcctccagcccatccagggcggccgctgccgcgtcctcatcggtgagcaccagcactgcaatctcctccgccccggcggacagggaggtgtagacggcgctgccggtgatggtgtcagcatcaattccgtacagggcggcggcggtgtcctggtctacggtgtccaaggcatcgctgaacgcgccggagtccagcagggcctgggcggccgtctccgggtcatagggggtctggcccaccgccccgccgcctccgcaggcggtgagggccaggcacagcagggccgccggcatcaggcggatcaacagggatttcatgtttcattcgctccttccgcggcggtctggcccgccgcatagcagtccgcatccacggtgtgctccatcaggtaggccagccacttctggtaccatgccttggtaaagtgtaccccatccacggtggagtcggcggggagaataccgttttcgtcggtgagggcgtctgccacgtccaggagcactacctggtactcctcagccaactggggaaaaatggcgttgtaggcggccacccggtcgttattcacatagtaaggctgcttgttggcggcgcacttctccgcgttcaccggcaccagattttccagatagaccaccgcgccgggctgactggccttaacctgcttcaggaaatcaccaaaggtctggtggaacgcctcatcattaaaatatcccagttcattgatgcccagggatatgtagattttggcgtattggggccccttctccagggcctgctccaccgtgtacttgccgccgtccagctccaccacggcgcggtcgtccatctcgaacacggtcagtcccttgtagcagtaaaagtccgcccccttaatgccgctgtagaggcgcaggccgtcggtgcgggagtcgcctataaacagtgcatcggcaaagtaatccatctccaccgcctcggcggcaggggcgggctgggtgaaatcaaaggccgcaggggtcggctccggcgtgggtgtgggctccggcgtgggctccggcgtgggtgcggctgtcggggtgggagtggccgccgcaggcgggctcgctgcggcggtgggctcctctggggcacggcccagagatgggatcaggatcaggccgaggcacaccgccgcggccgccgccagcagaggcagcggattgtgcctgcgcggcctgttttgcgcccgtttgggctgatattgggatggcaactgggacacctcgattaaatattgtttttttcttctttgagaattagcgcttggagcgccgcgtatccgtccacctcccaggtggggacgatggcggggtcgccgggcagccggcccggattgtaccaagccgtgtctagcccggcctggatgcccccctggatatcggccaggaggttgtcccccaccatcagcacccggcgggggtctggattccccagtgtacggagcaccggggcaaaaaaggcggagtctggcttgctggcccccagctcctccgaaataaacagccaggggatgaggccgttcaggggggatgcctcgaagcggcggcgctgggcgcgggccacgccgttggtgacaatggccagggtgcagcggggggccagggcgcggcacagcgcctgagcccccggcaggaggtaggagccctcccccaggtggtccaggtaggcccggttgagggccgcggcatctcccgtccggcccagggcccgcagcagggcggcaaaccgctctaccaccagccactcccggcgcacctcaccccggtccagccggttccagagcgcccggttgatggataagtagcgcgcctcggtctccccgtcggcgggcagtcccgcctcctccagcgtctggcggagggcctcgcgctcggcccggtcaaagtcaaacagggtatgatccgcgtcaaacaggacaacctcatagcggggcatggtatctctcctctctcagccccggcggcgggactggtaggtggtgaacaggcggactacggaggccaccagcagcacgcccaccgccagcgcgcctgccaggcccagtgtatgcatcagtgtgtccagaaacagctcggtgtcgccgttcagggcgtgttccatggtgtagtagatgccgccgcctggcaccaggggaaagagggccaccagcaggtagctggtcaccgggcacttgcgcagccgggccatcacctccgaccaggccgagatgaccagggcggcaaaaaaggactggataatatcgttgcccaccagcggcccggtgagcaggtagcacagccagcccagggccccgccgccggcgcagatgagcatgccggcgccgtggatgttgaacagcatggaaaagccgatgcaggccaggaaggcgtagacacagggcaggagataaagaagggcctctctcatagcgcgcctcccgtcaccatccgggtcaggcccagggccagggcggtgcccagagcgatggccgcgccgatgagcagcgcctccgccgccttgctgatgcccgccaccatatcgccggccatgatgtcccgcatggcgttggtcatggcgatgccgggcaccagggccatcagcgcgccgatgataatgaggtcctggttctgccccaccccaagccgggtgagcgccacggccgccagggcggaggccgcgccgccggcgatggtacggaagaacaggttggcgcccagccgggtcatcaacgccatacaaaggccgatgaccatgccgcacagccctccgcacagcccgtcggtcggggttccgccgtagaacagggagaacatgccgcagcccaggaagtgggcagccagttgggtgggcagggagtagacccggtgggtgcgggtaatggcctccatctgctccagcgcctcttcaaaggcgggggtctcccggcacaggcggcggcacaggccgttgtacttctccagcaggtagatgtcggtgccgtgggttggcatccggcggatctgggtcacgggccggccgtcgggggaggtcaggctgaccatcaggcagttgggaatggcaaagacctccccccgtggggcaccgtaggcctggagaagccgctgaatggactcctccacccggtagatctccgcaccgctcttcatgagccggtagcccatctcactgaccatgtccagcagcttgttgtagtcgagctccaatgtgggatacacccgccttttcaggtttgaaataaatgggtcagcggcatcacgcagatgccgcacagcgtggcccacagggccggccggtcgtggccgtactgccgggaggaggggatgagctcttccaccgcgatatagaccatgatcccggccaccgcgccgaacagcacccccagcagcagcccgttgagaaagggacgcagcagcgcaaaggccagcaccgcccccaccggctccgtcaggccggagagcagggtgcagcggaaggcccgccgccggcttccggtggcgtaccacacgggcatggccaccgaaataccctccgggatgttgtgcagggcgatggccagggtgatgctcacccccagggtcagatcctcataccccgccagaaaggtggccacgccctccgggaagttgtgcagggccatggccagcgccgacacaaagcccacccggaacaggtttttgtggggggcctcgccggtgtcggcgtcaaaggcgtcgtggggaaccaggtggtccagggcggcggcgcagccgatgcccgcggccagggacagcaccgccgccagcgcccctgggcggccgcccagggatgcagtcaggtgctcccgcgccgtggggaacaggtcggtgaaggacaccgccagcatcacacccccggcaaagccgagggagaccgccagcagcttttcactccttctccgggcggcaaagaccaccagcgcccccagcagggtggacagcccggcggccagggacagcaacagcgcgcggacagcggcggattccagcatagcagcataccccgattccttgtgtggtacagctactattccacacaggccgggatttagccgcgccaagttcctccggcggccggttcagccgtttccggcggagcacttggccgcgtcgatggccagcacgatcatcaggcacagcagggcgtcctccggccgggcgatgtccagcacataggtgtcggtccagtggagcagctccttggacgcggccatcactgtgcgccccgccgggtcggtgacggcgtagtcccactccagaaagctgccctccacctcccagccgttgcagtccagtgtaaaccgggggtgaaacagggcaaattccttgcggatgcaccccaggtattcctcccccgcatagagggcgaaccggggcaggagggtcagcacttcttcctttaccgtccccaggtggtctccggccgggccgtagatctccagccggtgtccccaggacagcttgccctccacggtataggcggtgcgcccctcctcgtcatagatgtcatagctgtcaaaccaggagagaaaccgctgcttgaacaacaggcgcatttgggcctcctttccgtgccaacgtacagacgcgggcagcctgcaaaaagttgcggatcgcccgacaaaattcgggcggaatgttcttcacgtaatcctaacacgaaataagcggcctgtccagaaggggatgcgcatccgccccaaaacgcgcaaacgggccgcgccatgggcgcggccctcagcctgccgaagccctcttttcgacaggctggaagactgtttaaatctttaaaaccgtttctaaaagtcgtttgatccggcatgaaagggaaccctgacggttcatccccgcgccaagcgccggcgcaaagcggcggcggcgctccgaaccgccctgcggggcagtctccgctccggggcggtcaggccagcccgaagcgggaggcgtcctcccactccgtcaggccgaggcgctgccgcgccttggcctgctccagcgtcagcctgacagggtcctcctgcaaatagtccagcagctcctgaatgccctccctggtaaggttgctcacctcgaaaatccgctcacagccggagttgaccatccagttgcgcaccatgggcacgttggcgtagggggagtcaatcttcgtgatgatgccgatgagcggccggttggtgaagcactggcagttggcttcaaaaacgctgaagggctcgtcagccgccatcagcagggccagcacgtccgcctcaaaggagaagcaggccagccccagcccgcaccgcttggtctccgaatactcccccggcgagtcaatgatgtccgtccccgtgttggtgtactgggtcttgtggtagtgcagctcctcgcccgataaaatctgggtcagggaggtcttgcccgcctcgctccggcccatcagaaataacttcttcatctctctttgtcaccgctccgtaagttcacagacggtgaagcccagctccgtccggaaaaattccaccacatgctccagggcgctcttgacctccgcccggctgcccaaaaggatcaccgcgccgctgaaccggtccagaaagcccagctccacgtttccgctcttcatggccacgtcggcggccaccaccgtggcctcccacggggtcaggtgcagcaggccgatggactggccggtgtgatcctcccccagatgggtgccgatgtgcagccccaggttctcatagacccgccggtccgtcacgccgatgagctgggccagagagagctccttgcccaccacccggacccggaccgtacgcagctccctgcccttgagttcctcataccgccgggagaataccgcctccaggaactcctcccgtgtcatacgcttccccatcgccgcgcctcttaccgcttggtgatcctgcacaccacataccccagctcatcgcggaagtagtttacaatctccgtcagggcagaggtgacgtccgccagctcgcccgtgatgatgaccgtgccggtaaagcggtcggcaaagcccaggtatacgtcgccgctcttcactgcgatgtcggcggcgatcaccgccgactccggcggtgtcatgttcatgatgccgatggcggcggcgccgtagtcgatggccgggttcaggcccagcttctgatagatgatgggggccggcccgccgatgacgtgggcaaaggtgatctccttgcccgccaccgtctcctgcacaatccgaattttatcattggtatcgctcatatgcgctccgccccctgtatccttctctcccaacggggccatgccccggtacgtattttttattatactattttctccgcgggaatgtcaatgcgcagggcgctcttgacaggatgcgcctggcggagtaatatacttatcaataatatatattatagataagtatatggaggacgattttgtgaaaccggattgggttcaaatgtcagagtatatgcagcagctgcggcagttggcccggcgggccgccgtccaccagcgcctgcccctgaccgggtcggagctggagctgcttgcccgcctgtggatggcggaggagccggtgacccccctgggcctgagccggagcatgggcttacagcaggtgaacgtcagccgcctcatccggggcctgcgggcgcgggcgctggtggcggccgccccctcccccaccgaccggcgcagctataccctgtctctcacccaggcgggacggcaggccctccaggacgggtgcagggcgtatctctcccccctctaccggatgcgggaggggctgggggaggcggagttcacccggctgatggaggagatcacccaggccaaccgccgcctggacgccgcggccgtgaaagggggtggggagccgtgtccttctatggactgatgcagttgggggtgccccagctcaagggcctgctccgccaggccgccggggccgagcgcaggcggcttctcctggccctgctggcccgggacgccgcctgtgtggggtttgcggtggtgtttatctccgccctcaccgccctgttcggtggggccaacagccccgcggcggtggtcattttctgtctgctgctcagctgccgctttgtccattacaactaccgcatggccgacaccctgcggaacatggcggccgccttcgccctgctcacgctcgggcccgccctggcccctctgggcgggcccctgctccacctgcttctcaacctgttctgtatcggagtgctgctgctcatcaccgccgaccagcccgagctgggcaacgcctccctctacctgttcagctatcttttcctgtatggaaatccggtcagcgggcgctcgctcgccctgcgggggctggagatgctgctgggcttcgccctgtgcgccgcggtgctctaccataaccaccggggcaggacaccggagcgccccttccgggcggtactccgcgccttttccctcgccgatgaaaagtgccgctggcagctccgggtggccgtgggcatcagcctggcggtgctcactggggagctgctgggcctgccccgcatcatgtgggtgggcttctcgtgcagctccattctcaccgcctacgggtcccaccccgtccggcgggcggcaggccgggtgggcggcgtgctgggcggctccctgctgttctgcctgctctatcagctctgcccgcccgccctccacggcggcctgggcatcctgtcggggctctgcctgggcctgtgcgccagctacggcttctgcaccgtgttcaactgtctgggcgccctgctcaccgccagcgccctcttcggtcccggccccgcggccgccatccgggtgtgcaacaacgtgctgggcagtctgtttggtcttttctttgcactggtatggccctggcttctggacgcgctgtcccgccgccggacggcggcggcccgggagagctagcccgccaggaatgccacgttgtcccggatgcgcccatcctccggagccagggccagggcctgccgggcggcctccagggcctcggcccgccgcccggtgtggtacagccccagagagagcagatcccagggcaggctcccccacgcctctgcctcgcagatataggtctgagggcggtcggtaattgccagggcctgacggcacagatacaccaccccgtcccactccgcctcctcatagagcaggcgcgccagctctaggtagggctcccgcaggtgaggggcctccccgatggcccgccacagccaccgccgggcctgctccggccggcccttctgccgccacgcccgggcgagaaaccgcatggaggcgcaccgctcatccgcccagacggcggtgggcagggacaggtggcgctccagcgtgcggatacagtcgtcccaccggccgtagaacaggtactcccggcccaggtaatgggtgttgcggtcgtcctccggggcctccgccaccgacagctccagcaggggcaggtactgcccccgggatttggcggggtcggcgtggtggtccaactgcaccccctccgccgtgcacttccgccccggtccccagccctcctgccgctccaacacctcgtgaaccgggtgggtccagcggtatccccggcgggcgtggatcttctcaatccagaacacggtgccctcggagccgtcggcgttgaagttccaggtatagcggtagaccgcctgggtggtcccgtccgtccaggccgcctccagcgccgcccgccagcccgggtgaaacacctcatccagatcggtacacacacagatgtccgcgtcctccggtaccagctccaaagagcggttgcgggccgtgtcaaaccgccagggctccaccctctcttccacaaccaccgcccccagggcacgcaggcgctccgcggtcccgtcggtggagccggtgtccagcacatacaccccgtctgcctccgccatggaggccatccagcgctctgcatatccggcctcgtttttgcaaatggcataaaccacaatcttcacaaagcaatcccccttataggaacgccgcgggcggcgcagcagcgccgcccgcggcgtttttttggtgcctgtactcaggtgcccagcagcccggccgcccgcaggttttccagaagctggttaaaccgtgtcaccacgtccgcggcgctggtggcgttcgccactgcggtcgccggggtcacggacgggccggtcgggcctgtggcgcctgctgcgcctgtctcgcctcttggcccagtcgggccagttgggccagtcgggccggtcggacccgtcaggccagtgggccccgtcgggcctgcgggacctatcgcacccgtgagacccacggcgccggtggggccggtcgggcccgtcggacccgtcgcacccgtagagccgtgtatttatgcacaacattagattttcctttgtgttgagtaggcaagccgttagattgccttgttctcaatcactcggataacgttgtggttattctcaatgtaatcaataattcgctggtactcgtcggcaaaattgaagtcaaccgttatttccccgttctcatgcacccaaaccgcttttacgagttcaaccataatcccgcggttaaggctctgaatgtttttgtatttcagaaaggcggttagatacgggtcgtcggttccgataccatcagccattacctgcatttcctctttcagataggagatgttcgcttcaagctgttgtatctgttctgcaatcttgcctttcaagcggcgatattcctctttggtaatctcaccgcttttccaatcaaggtacaagctgtcggaagcgtcattgtactgttttagctgcttttctgcctgtttcaaggaatgggataatctcttgctttcccggttgataacaggcgcgttgttaatccgttcaatttcttctgcaagccgatctacaagggcaatttgcatttgcaacgctgccaataccgcgttttccaacttgtcttgccggatagaatgtttgctgcaaatcttcttatcggtgtagctacggcaagagtagtaggcaatatcacgggcggttttgcgccgcatggcctttttgcaatccgcgcaacggacaaagccggacatgagatagacttcctgtttgccgggggctgtccttgtgtcgcgcttatgtagggcttgcgctttctcgaatgtttccctgtcaataatcgcttcgtgtgtgttggggacgacaaaccattcttcttcggggacgttgatctgcttgtgtactttgtagcttattacgcggttacggccttgcaccattacgcccgtataaacttcattttgcaatatccttgcaatcgtgctggcagaccacaaaccatcgtttttgtcggaattagggttgttatacttaaagccttttttcttcttataggcttcggggttcggctctcccatttggttaagccgctttgcaatccccattttactgtacccctcattgacaaaccaatggtaaatgcttttgacaacttccgctgcttcttcatctacaatcaagctgtttttgtcgtttgggtctttcttgtagccataaggggcaaacgcgcctatgaactcgccgcgctcccgtttcatcttgaatgttttgcggatttcttcggaagtggtcgcggcaaactgctcattgaacattcccctaataggtacttcaagaccgcttgcagaatgggggttagcgtaagtgtcaataaatggcgtgcctgtgcaaataaaccttgcgccgtgaatgggtatgaactcctccaaaaacttttgttgatcggcaaggttgcggaaaccgcgtgcaagggatttgataatcatgcagtttacttctttgcggacaatgcagccctcaagccgtttgaagtttggtcgcgctgtgtcggtgcctgtcaatccgtcgtcggcaaacacgtctacaatcacataggttcccggctcaaaatagctgtctacaaagtcgcggagtatcttttcttggttgataacactctcgctttcgtcctcgttgtcgtcctctctggatagtcgaatgtatagcccaattttccaaaacggctctgcataactgcgtgccattttgtctttgcgtatgcggggcattatacctcctttccccctataattacgagttaattataccattttcgccccgtaatcacaaggtctttacccgtagagttagggaaagtcggcggttatttcagacttaaaaagtaatcacacaatgattgctttagcgttctatcctctgcgacaaaccgtattcttacgggtgtatcaccacaaagaaaacagtatggatttacaatctgctcaaagtagctttgcattttctttgctgctggcaaagaactgtcaatatggatattacgaatatcaaccaaagtgctgcggtcaacctgtgtaatatcaacatttctcatttgttgaagttgtaacttggtaatcatcttctttccctcccggttagcggcatagtacagaatatgcgctccggcttgtacgatatgagaaataaggctgaaacgggcggttgttagctgcaacctcacgggagtttcaccccggcccatgcttatgggtgcgccgcgcaatactttgagggtgttcaacgcgggagtatcattgtgccgccttgtatgtcgtcgcccacaagctgctaaacctgttttacggcgcggtagttgtcgctcgacttttccccgtaggggaaaagctgtcatggcgtacccgccgactggctcgatacagacggaatgtacccgttgcctgttatgctgcgcaccaaaggtcgctttctttgtcaagttacaataggctttgtcggcctgcaaaagcacatcaacagcggatatgcttttgcggaacgacaaatagcccataacgggaatcgtggaaaggggacacgctccccgcatgggctaaaagattatcctacatgaaaagcaagggtgcgggtaataaggcgcacttgcagcctgttacgcatttcctcgtccacataggaataggtattgcccgcgtcgtctttcagcgtgcgggtacaaagtttcgctatgtaaccctcgtaatgcttcaagatcgcgcacatggcggttgtgtcgccgtttgccgctgcggaaatgacagggaacggcaacagattttcagatttcctaacggtattcatcatctgcttttccctccaaatactgtttgattttcgcaagcgcggatttcctgtgccggaaaaccgtcgtgcgtacaacattcagcagttcgccaatttccgcgtcgctcatatccaagaagtaggacaaaaggataatgtcgcgtttcctttcgggcaaagcgttaagggcttcggcaagcagttcatttttgacgagtacatcaaagccggacacttgaaaacggaaataatcgctttcgtattcgtccgttgtgaaaagctgcgcgagttcgctttcgctcaaatccgaaaaagtaacttcgcgtgctgcgcgtttcgcaagagtgcggcggtggcttttcgcttcgccgaccaaagttttctttgctaatgcgtcgtactgatgttgtattctttccttgtcggaagaagatagctccatagagttcacctccttcccgcgtggagtagaggacgggagttaagggcttgtcctctctgcccctttcgctccgtacccgttcgggagatggctcttgagtgcgcttttcagaaaaaagttgaaaaaagcaaaatgcgcccgtccgcaagacgcggacgggcgcaaaggaaatgtaagcagtagctaaatgtattgacagttcacattcatagccggaatatcccgcttgcggagcatagctttttttgaccgcaaagcattaggcgggttacagtaaataaaaatggacacggcgatacctccccgataccgccgtatccttaaaaaagggcgactttaatacactacccgcaatccattctataatagggaacagcggcttttgcgcaatattaaataaaaaagccgataacacataggttttttgacctaatgcgttatcggctctgcgtctatgcgtctggcacttttaatcattttttttgaatttattatatgtgttagctaactgtccacaagccgcgttaatctctctgccatgagaaactctcatagtaacttcaagtcctgcttgctctaattgatgtttgaatgcaactatttcccgtttctgtggtgctttaattcttgaattgcttgttgggttgtattgtaacacgttaatcataacttttttgccccgaaaccattttgcaagttgtcttacatctgagggccggtcatttatacccggtaaaagcaaatacgcaaagacaattttgcgattatgcctttcagaataggataaggcttgcttaacaacatcttcaatagcatatatgcgcatgtgaggaataatacgatttcttgcagattgtgttgctgcgtgtaaagatattgtcaactgaattttaagatgttcctcgcgcaatttttttaattgatcgaccggaccaactgttgatatggtaatgccgtcggttggaaagttgagcccatatctatctcggagaatatggattgcttttatcaagttgtcataattgaataaaggctctcccatacccataaaaacgatacggtttacttttcgacgcaacaatataatctgttgtacgatttctgacgatgttagattacgaacaaagccatttcgcccggactcacaaaaaatacaaccaacaggacaaccgacttgtgtgctcacgcaaacagttccaccatctcgccgcttgataaaaaccgtttcaatgtatttgttgtctttcagttcgtaaacatacttttcagtatcactgcttttgcaaatattttttaccaacattgatagattttttttgcgtggtaattgcttatataattcttcatataaggcttttgcttcattctcgccaataacttccgacatttctttgtaagtaaatccgtatggatcattccgtacttccgcaggcgtatatttaggtaaacgtttcatttttatatcctttcttctaaataataaaagtttgtttttctgtatttttgattacaatctctaatttttctacatcaatgatatgcgtcaatttgcatttagggcagaaaagaggaaaatcttttaatacagtattatgaaatacttgaactctcgtctttccgttacaaatcggacattttatccaatattttttaagcattatatttcactcgtcctttttacacaaaaaaatgcaggtcaatcctcaacatgagcattgacctgcatttataatgcacagagcagtacaacaaaactaaggcatagcttgcactatgtctatactatatctatacgtcgttagttttttgtatagcatccgcaaaataagcatgacaaaaaagcccatgttgaaaatgggaaaatcctttttttcaatgcttatctaatacgcatgctatgcaacataaacgccgcctccttttacataaattttattttatcagaaaatcagtctactgtcaatacacaacaggaagtatttaacctaatgatatgaattgtgtggacatatccaaaaagaaaggtgaactgtaaaatgtaacagggtgaatgaaaatggcaaaaagacccgtaccattgtacgactttaaggctttcggggcagctataaaagccgcgagaaatgaatacggcgagagccgcaaaaaggtaagcgacgagttatatatttccccgcgctaccttgcgaatatcgagaacaagggacaacagccgagtttacaggtattctatgaccttgtaacccggtatcatatttcggtagatcaatttttcttcccgaacagcaatgcggagaaatccaccgggcggcggcagcttgacgcgctgctggacggtatgagcgataaaggcatacggattgtaaccgcaacagcaagggagataacggaagtcgaaaaagcagaggattatcccgttgcggctgctcggctgctatggcaaacgcctgtgtgccgtttcccataatgagatacttcccgtcctccgacgcatggtgaaaaccaaagcccgccgcttcgatctgttcgcgggtcatatcggtaatatgaaaattgcccctcggcgttctaaccgtttcacccgtcataaggctttcgggggtcgcttccggctgctgcttttcaagctgcccgtccttgtagaaatagccttgcgccgcgattgcttcaagggtcttgcccgtaacgtcgccataaatccgcttgtctgcgtcaaccaggatttgcagagtgtcttttaccgtgtcggacaaggcttgctgctgttcgggcggcagcttgtcaaataccggggtctgctgctcctgctcggcttgccgctgttgctgcaactcggtaaaatgcccctcaatctcggtaatgagttcctttgcggtagtctgtatcgtttcaagggacgcttttaactcggtcatttcctttccgctgctccaacccgccacatagccgaaagagtaatcggaagtatcaaggccaaagtgctggcagacggtataagcgacgctttccgcttgtacctcgcgggtatggcgtggggcgcggttttgttcctccggcggggcgtttaagtctacatcgtgcagcttcgcatgggcgatttcgtgaatggcggtctttaccgcctgtaactcgctcacaccctccttgattgcaatacgcttgtcggtcaaactgaaatacccgtttgcgctgccgccgatctgctcaaaggcaatcgggacgggggacgctttttcaagggcggcgaaaaaatcctcgtactgctccacatcggcaagcagcggcttaacggaaaggtcggggaactccttgccctcggtctgtgaaatatcaaagacagttataaccttaaaggcggggacggtgatttccttttcttccttaatcggctttccctcgcggtcaagcatgggctttctcgtttcggggtcgattttgtcaaccagctttttcaccttgtagggggcgggggcaaagattttaatgcctttctcgcctttctttacatggcggtcaaactccttttcccattgacggaagcccattactaaattgccgccctgcatagcaattaggataagatactgcttgatgttgcggattttggttgtgttctccctcatgcagtccaaaacaaactcaacgtggctgctgttcagcttcataaactttgatttgacaagttcggcggggtagtcgtccccggcgatacggattgtctttcgggctgtgcagacggtttccagcatgatttctacaatctcgtccaaacggtctttatccattttggggtcttgaatgagaatgtcatagtcgatgttgtctttgatgatttcccgataaatctctattgcgctgtttgttttcgcttccgttcttttcctttccggcggcgtagccgcttcgtcctgctcataaggcaggggatttagggaatggaaaggaatggaatgggtacttgatagatcagtaattgattgttctttacttgatatatctttatttaattgcgttggattttccaacgtaggtttttcctgcgtaggtttttccaacgttggattatccaatgttggattttccaatgtaggtaaatccgatgtaggcggctgttcactgctggtagctgcttccggctctttgggctgcggctgctcatatatgacataatccgcaccgcgcaaacgtcctttctcgtcgcgttcccggctgcggacgatatatccggctttttcaagttctttgaccgcttcgcggattgcgtcgatcttctcccggttgatgtgagataagcccgcaagggtataatcccaatcttcgggtaaggacagcatttgcgaaagcaagccttttgcctttaaggtgagttccttattgcgcaagtggtggttgctcataacggtatagcccgtatttctctcaactcgaaaaactgccatttttttatcacttcctttctcggtctgcgtggaatattagaaagccgttttcggcggttttggtattgcagtatgcctttgctgtttttacgtctgaaaagccttgtattataagggctttttcgcgcctaacgttccacgttaccgcctgttttcgggcataaaaaaaccgcaactcttttcaagctgcggcgacatatcctactcacttaaaaacgccatatcaaggcttgtccaaccttgctacggcgttttaggtgtaattatagggggtgtttaattgtctttaatgtgctgaaagccgcatggttacggcattttccttgttgtgcatatattgacggggcagtcaagccagtgggccccgtgaggcctgcgggacctgtcgcacccgtcagacccacggcgccggtggggccggtcggacccgtcggacccgtcaggccagtgggccccgtcgggcctgcgggacctgtcgcacccgtcagacccacggcgccggtggggccggttgggcccgtcggacccgtcaggccagtgggccctgtcgggcctgcgggacccgtcgcacccgtcagacccacggcgccggtggggccggttgggcccgtcgcccccgtcaagccagtgggccccgtcgggccggtggggcctggatcacctgtcccgccctggggacccatggggcccgcagggccggtgggaccgtccggtcccggaatcccctgagggccggtcggtccaaccgggccggtcgggcctggaatgggagggggagtcggcggacagggtggaattggcgggcagggcggaaccggatggcagggggagcacacgcagggccgccgctccggctgggcattgatgcggttcatggcgcactctccggtggaataccccccaaggggaggcatacaatattctgacacgcggcattctccttttcagagcatttggcagagcggctgtcgggccgttttctctgcatcctatcctatgtcctccccccgtcccccgtgcccggccagcagagcgccccgcctcccgaacgggaggcggggcgttccttcatattgtgtatatgattgggaataggccctccggaaccccgtacggaagtctctcacatatagaatgttgaaaaacgccggggacaggactgtgcggtacagttctgtccccggcgtttttcaaatggagcaggcaggtctgcagccggctgtgatgtctggtccccctcaaacttcatcgcaaaaattccaaaggctctttgcagcgccggaaagcgttttacatttttttgatattaagccaagcgtccacaaaaactccggattttgaagcgagatgcacttgatcctgccgctgtacagcttttccaccaaaggccgcccaattagggtcacaccctggttttcagccgtcatttccagcaaaaggtcccactgggatgtggtaaacgtgatatttggcgtaaaccccgcctgccggcaatgggcaagcacctggtcgtgaaacatatagtccttcgagaccatcagcatcggctcatccctaagctcggcaatttccacttctgtccgctctgcaagccggtgattccgcgccactgccagcaccacatcagaacggtagacggtctttaacctcatatgcggattttcgtatggctcaatcaccacgcccaggtctacctgatcattcatgaccagtgcttcaatctttttggaggttccctctacaatctgcaaatcaacctgcggatatttacagccgtattcaaacagaatctttgaaaaaaaaacgctcccaaccgacggtggaagcccaaaccgcagagaaccctttacctgttccagcaaagaaaacagctcggcggtacggctttgccagtaattcaaaatatccaccgcataacagtagacgttttccccttcgctggtcaggctcagctcgcggggatcgcgcttgaacagcgttacaccaagctccgcctcaagggcgcggatcgatttgctcagtgcaggctggctgataaagagcttttctgcggcctttgtaaagcttttctcctccacaatacgcacaaaatattctagctgcattcgtttcatacatactccctcagccgccgcaggccgtgatgccgcaaagccatgattcctcctacacaaaaaaccattcgaacagtcgagcgaattgtatttttattataaagtacatgacgccttttcgcaaatttcttttcggaacacgggatgcggcaaagagtgccgggccactagccagagagaaaaaacagactataatataggataatttccaataaaacggggctaaagttcaaaaaacagcaacattattttcggcataaccaaaattcatgcggcgataaaaaaggtgtatttttcaaaccatagcccttcaactataatcaaattgtcgaagcaggcaagacaaaatccccataatcggacaaattcctcaaaaggcggtgtgtggggcggggttcattcccttcctctgcgccctgtcccacgcaccagacatggccccacgagaaaggagcgttatcctgtgaaccagtatcaggaattgtacaagaagaaacgaatgagcgctgaacaggctttggagcttattcaggacggagattccatgttttccgctcaggctgcggcggagccccaggccatcctgtccaggctacagcatttgaaggagacgggggtaaaaggcactactttgaactcctgccttcccattcagtattatgatgcgatgaaggaccccgagatggcaggtatcatgagccacaacggctggttctttaccgccgggctccgggacgcacagaaaaagaagctggtcagcgccgttcctcagagctccacctccgttctgcgaaagtctctacagcgcctgcaggccgagggccgccggcccgtggtgctggccacggtctcccccatggactcccacggctacttttccctctcggtcagcgcaatctatgagcgggacctgatcgatcagggtgcgctggttctgctggaggtcaaccccaactttccgcgcacctttggtgatacacaggtacatatttccgaggtggatgcccttgtggagtccgaccgccctatccccaccaagtccctggtgccctacaccgaggtagacaaaaaaattggcgcctttgtggcctctcttgtagaggacggctccaccatccagctcggtatcggcaacatcccaaacgccgtagcaaatgagctgaggagcaagaggcatctgggaatccacacggaaatgtttaccgagaccatggtggatctcattgagtgcggcgcggtggacaactcccagaagggctttatgaacggtttttccgtgtgctccttcaccatgggcagccagaggctctatgacttcgtccacaacaacccctccgtgctctttaaatcctccaccttctcaaacgatccctacaccattgccagaaacaacaagtttgtctccgtcaacgcaagcctggagatcgacctcaccggacagtgcgcctctgaaaccgtcggcaaccttcagtggtccggcaccggagggcagtctgagacggtacagggcgcgcagatgtccccgggcgggaaatccatcattgcaatgcattccacctattcggccacagatgcagacggcaaagaggtgctgcactcaaaaattgtccccttcctggcgcggggcgccgcggtcaccacttccagaaacgacaccgactacgtggtcacggagtatggtatcgcctggctgcggggactgaatatcagggaacgggttgaggccctggtcaaaattgcccacccggacttccgggactggctgagagaagaggccgaacggaatatgatttggtaaattgggacgggccagagtacctccggagcttgtccgccctttaaattccattattattctttaatggaaatatagtgcttttactgtcctgacctagcgttaagcgagcgcctcccagtacggaatcattggataagaaagagaggaaaacgtatggagatcatcagcgtaattggcatggttcttggcgttgcagtcctgatctatttgacctttaagggtgtcaacggctttgtggcatccctggtcggctcggttatcgtgattgtaagcagcgggctcccgttctgggggactctgaccggcacctacgcggcctccctcggaagtaccttcggctcgtacctgtttctgttcaccattggttcggcttacagcgagctgatgaaaaagagcggcgccgccgagtctatcgcaaattttctgttcgccttcctcggcgtgaaagccaccgtcgccggaaccctgattattaccttccttttggcctatggcggtgtaaatgcatttattattatttttgccgtctatcccgtggctgtgcccatgttccgcaaagccaatgtctcaaaactcctgatgcccgccatcttcctgtatggagccgtggttctgaatgtcgttaccccgggcgccccctctatgctgtgcatcgcattgtccgaaaagctgggcgtcaccacctttgcggcccccacgatggcaattgtgctccttgtagtggctttcggcttcggcattttctacttcacctgggcctccaactccctgcgtgcccgtggaattggctttgtagcctctgagagcgacgccgaactcatcgccggaagcaccagcggtaaggaactgccccccattcacctggctattctgccctatattgtcattattgtgcttaagctggtgctggccaactccatgagcgcctccgacggcatcaacaccgccatgggcgtgggcgctattgttctaattattaccaattataagtatctcaagggccacatcgttcaggacctggttacaggctttacctccagcatcaatcccctgctgctgaccgccgcgctgatgggctttgcgtccgtcgtcaatgcctgcgccggtttccagtacttcatgaactttgcgatgatgctcgccgacaaaatgaacccctacatctccgccgtcatcgtaaccaacgtattttccggtattaccggcgcctccctcagcggcacccagatcttctgcagcaccatggccgaccagttcatgtccctgggcaccgtcaatccccaggcgctctacaaggtcgtcggcatggccgcgatgggcatggacacgctgccccactgtcccaccttcgttatggaggcccaggtctgcggcgtgaccaccaaggagtcctaccctcacgtactggtcatgaccgtgatcacccccatcgccctggcgctgatcgctgcaacaatggcaatcatcgggctgatctgatcactcagagtccacgtaaaacggaccggtccgaacgggtcagcaccgcgcaatcggatgctgacccgttccgcttttgccttcaggagaacagccattctatgttacagaaagggaacgaaacgatatggcaaagatattaaccgcccgccaagcggtagacacctatttttacgatggggcaactgtgacgttcggcggctttgcaaacggtctgatgcatccggaggagattatggttgcgctggaggaggccgccaggagcagtggacacccgagagggctgagggtcgtgtatgcgtccgggcagggcgacagcggcgagcgggggcttaaccacctggctgtagacgggatgtgcacaacggtgatcggcggacactggggcttggcgcccaagctgggagggctggcggcggagaataagctggcggcctacaacctcccccagggggtcatctccgggctgttccgggagatcgccgcgaagcggcccggcgtgatcacccatgtcggcctggacacctttgtggacccccgcctggagggcggaaagatgaaccgcgccgcccatgaagcgggcgatatggtcaagctgattgagctggagggcgaggaaaagctcttttatcccgccttccccattgatatcgcagttatccgcgcgacctatgccgacgagcgcggcaactgtacctttgagcgggagggtgtctacgccgaggccctggcccaggcgcaggccgcccataactccggcggcagggtcattgtccaggtggagaaggtggtctcctacggctgcctggacgcacggctcatccgcctccccggtatctatgtggatgcgcttgtggtggcccggccggagaaccacatgcagaccttcggcacccagtatgaccccgccttttccggagagatccgcacccctctgaatgctctgtccccgctgccgatgggtgcgcggaagatcattgcccggcgggcggccatggaactgaccccctgtgcagtaaccaatctgggcatcggcatgccggagggcgtagcctctgtggcggcagaggaggggctggagagcatggtgctcacaaccgaggtgggtgccgtcggcggcgtcccggccggcggcatggattttggcgccgccaccaatgtggactgcattctggagcagccggttcaattcgacttttatgacgggggcggactggatacggcatttctcggcctggcccaaatggacggggacgggaatgtgaacgtcagcaaatttggcccgaagatcgccggatgcggcggcttcatcaacattacacagaacgccaagaaggtggtctactgcggtaccttcaccgccggcggcctggaggtctcagccgcagacggtacgctgaagctcctccgggagggcaaggtcaaaaagctggtcaggcaggtggagcaggtgacctttgcgggccgctacgcaatcaagcataaccagcccgtcctctatatcactgagcgggcggtgtttgccctcacaccggagggcgtcgcgctcaaagaggtcgccccgggcgtggacatccagcgcgatatccttgaccagatggagttcacaccagtcatcacagatgtaacgactatggacagccgcatcttccgggaggagcgaatggggcttgcgcagcagaaccccggctcaagcggaacaacgcaggaacaggaggtcaaacaatgcttattcgggaaatgaagctgggcgacagcgccagcgtgaccaagaccgtgaccgagacggacgtatacctgtttgccggcatcaccggcgatctcaatcccgcccacaccaacgaggtttccgccagccagacccagttcggcggccggattgcccacggcatcctgggggccggttttatctccgcagtgctgggcatgaagctgccggggcccggcaccatctatctgggccaggagctgaaattcaccaagccggtctatatcggggacaccgtcacggcgacctgtaccgtccaggaactgtttccggaaaagaatatcgtcaagctggacaccgtatgcaccaaccagcacggagacgtggtgatcaaaggcgtggctaccgccatgccgccgaaggaagcgtagcatacaaagtaaaatgggagcctggcgccgcacgttgcgcgccaggctcccatgctgttttgacttcggaggcggcgtacctcacataccacctccgcggattttggccagcaccgccacacactccacatgctccgtatggggaaagagatccaccggctggagcagccgggccctccacccccatccggccagcaggcggagatcccgccgctgcgtctccgggttgcaggagatgtagacgatccgctccggccccatccggtccaccgcacccaggaactccggggtgctcccggcccggggcgggtccaggaacaccacgtccgcccgctcgccccgggcggccatgccctggaggcaggccgtggcgtcggcgcagaggaagcgggcgttgcccgcgccgttggcccgggcgttctgggcggcgcaccgggccgcgctggggttgaactccacccctagcacccgcctggcccgccccgccgccgccaggccgatggtgcccacgccgcagtaggcgtccaccacggtctgggtgccgtccagccccgccccgtccagggcggtgcggtagagcacctcggtctgctccggattgatctgatagaagctggaggcccccagccggaaccgcaccccgcacagggtgtcctcgatgtaccccctgccccagagcaccttttcccgcggccccagcaccgcgctggagcggcggggattgatgttctgcacaatggtctccacccgcgggcagagctcccgcaccttggagacaaaggccctggccccgggcaggacaggggcggcggtcaccagggccaccagcacccgtccggtggcgcggctgtggcgcaccagcacatggcggacaagccccgtgccccggtcctcctggtagggctcgtaccggcagagccgggcggcctgccgcaccgcctccaccgcctcgtccagggcggggtggtggagcaggcaggaggccaccggcaccacccggtgggtgcccgcggcgtaaatgccgctgtccagccgccggcccggcccggtgcagaaggtggagatggccttgttgcggtagtgccaggggtgctccatccccaggatgggggacaccggcccgaactcccccagcagcgcctccacccgggcctgcttttggcgcagctgctccggatagggggtctccagcagggggcagccgccgcagccctgccgcagcagggcgcagatgtgtctctcctccgccatggcctcagctccgttccagccgcgccacggtttcgacagatgccccgcattcatcaaattgcgtgagcaccttttgctcaataggaaacttgtacgcaatcgcctttacaaagcgtttctgcgtcttttgctcctcacgcgggaacaactcaacctcggaaatcaggtatttcacaagatcgcgccgttctgctgcattcattctatcatagattgcgtcaaaagacgagaggattccaatcatagattgcacagacatctgctcgctttccagagttgtctttttcatcaggctctcttgcagcagatcctccgccttataaatctggtcatagaggtcattcaggcggcgggtcatgtctgcgcggcggcgctctgcatacttgtcatccggagcaatgcggtcaatatcccgctccaagctgtcgcggctgcgctgtaaagcggatagctggtttttgtaggcggtaatgtcattctcgacttcggtcatgtccacggcggtcattaccttttcctgcaaatccttgataaactgcggattgcgaacaatcttccgggtgtactccatcacctcgtcctcaacctgactggctaccacgccattcctgcggcataccgaagtccctctatgtttagtcgcataagaacagacataagattctgtgcggcgctccgtgccgtcctgatttgtccacttggtcataccgatatacataggtgcgccgcattgcggacattttacgataccggacaacagatgcgcgttatactgacctatgttgtgattaccttttttcccacgaatggctttgatctcctgcaccttgtcaaaatcttctttggaaacaaatgcctcatgggaaacaacctcactcaaaatatactcgtcctgcttcacaagccgatactcgttatctttgccgggaactttctctgtgcggcgcttgccccatgctacgcgcccggtatagattggattactgagcattctcttaatgtggtcagaactccactctccatagctggggcggatggcattctttgccggtgggcgagtataaccgtttcgattgagatagcccgaaattgccatgtagcccatatttcggttcaggaacatatcaaaaaccagttgcacgacagccttttcttccgggacggtctccaatttccctttactcttgtcatcaccctttaccagacgatacccatagggtgcaaagccgccgttccagccgccggactttgctttttcctcacgccccaaaaggctctgtgcaatgatgttctctcgctccaactcagctaccgcaccgagaatggtaatcatcatttttcccatagaggttgaggaatcaagcccatcttctacacacatcaggtgaacgccatatttcataataaactcaagggagttcagcacgtcccgcgcgtttctgccaaaccgcgataatttgaaaaccagcacatagtccgtatgtacttttccgctctgaatgtcatccagcatccgctggaactccgtccgcccctcgatactcttgccacttttgccttcttcaacgtaggtatcaagaacggtcataccccgacgctcggcgcattcagccagatagtgtttctgcccgtccagactatacccctttacctgacgctcactgctgacgcggatatagataacacacgatttgccctctttcgtattatacatagattgcctcctattgcaggaccgggcggtcatcgaccgcccggaatactctgctcagattttctgattttctttttctgcggcagcatacttgatcaggatttgtgccagaacattgataaagttctggtagcagtctctctgctctgctgtcatctgaatcacgctctccttgggaaagcgaagctcagttccattgtttgcagtgtagctcttgtagttttcgttttctaccatgtaatcactccatttgacgttatgatcgtcagccgaatgaagtgccgctctttcaacggtaactcagcagttactattatatgctatttccagtcttgggtcaatagctccggagcgattctccggtaactcctgaattgacatttctgcttgctctcatgtataattactttgaaaatccccggaggtgaagtcaatgagtatggctcaggttatccgggctgctatgaagaagcaaggcgtaactgtcagtcagctttcaaggcagcttggctgcacaacccaaaatatcagcggcaaaatgcgccgtgacaatttcagggaaagcgagttgcaggaaatagcggcggcgatcggctgtcggtttgagggtcgttttatttcagaagaaacaggaaagccggttgaataatattcctgtctcatgggtgggtaagctgctgcaacagcttacccattcagcatttctgcggcttttttgatattcgcgctggcattgcctttgcggaagttctccccgtcgaagcggatcgggacgcagacctccaagatgcggtcaaaaatgcggcggtcatccagatcggcagcttgcttcataacggaaagcggaatattggtcgtgacgatcattggcttgccggtcagcagccgcttgtcaaccacatcgaatacgcgctccttgccgaagctggtgttacgctctgcacccaaatcatccagaatgaggaggtcagggtgcataagcgatttcatataatggtcgcggtttgtgccgaaattgccctgcatacggttgaccacgtcggacattcccacaaagagaacggactccaaacggtcaatcagagcgttggcaatacagccagcggcataggactttcccgtgccgacattcccgaacaggagcagcccgatccccgcttttttgaactcgtcccagttctgcgcgtagcccctcgcctttgcaagctggggcgttgtaacggcggctgactcaaaccgccagccagaggcgggcatatcgcggaacgcctcgctgcggagcatcgtaatataggacattcgctcatattcccggcgctttgcttcttcccgttcgcggcgctcgtcagcgcacttgcacataatcgggtgcttggtaaagccctgtgcctgaaggtcagcgggaaaaaacgcttctttcggcgtatgacacttgccgcagtatttcagcccatcagcggaattgatgtaatcgtcaggtgcgacattagcagcttcaacggcatcaaccatttttgtaaaaatcggattcatagacattctccctcgttatcatcgtaggtgtagtttttcgcactcctgcccttgctgtcctcgtccagccacttcttgatggtggcatagtgattggcatagtgcctgtcattggaagccatgtaccgggacagccgctcaatgtattcggcagctttgccgggataagccgcttccagccgggtacattcctcgcctgacaggaaaacattttgaaactctccatatcggcggcgcgtactctctactctttcggtcttactatgctctttatgttctgtatcagtattacttgcgggcaatttctgccccatgcaatgggaagaatcctgcacatccattgggcagatattgccctctggacgggaagaaagctgcaccctgtccgggatttgcagaaagatgcggttcgcctggttccagccctgacggacgcgggtgatcagcccggcattttccagctcccgcagggcggtcttgaccgtccgctcactccggtcaagatcgtttgccatctgcttgatcgtatagatcacatacacattcccatcctcggacacccagccgcttttctgggaaagcatggtgcggttgagcagaagcccatatagcagcttggcgttgatggaatattcgcccgccagcatgaagcgcggcaagggaatgaacggcggcaatgtggtgttcagtttgaaatagatttttcatcacatcctctctggtctggtgtgatacggctgctatggcggttttctgtcaggtccgcgaggggagtacgcagctgtgccacccttttttgccctctttgactgataatgcggacaaataacggcaaccgcccggaaactctgcttgcaatcgtggacgcagcgacggcagagcgtgttgtacgccttgcgtccccggtcattcaggaagaacgaccattccatttttttgatttgctcatgcgcggcatatctgtactcctttcctgaattacaattcgtttctctgctgtacttttagcagttcccatacgtcagccattcgctctttcagttcagcaacatcggcatcgtagaaatgaccggtgctgttgatgcggcggcagacgaggttgatgtttgtggaaatcctgctgacagcggcagccagcttcttttgctcggtgtaatccaccttgatgatgtacccgtcgatgagcatcttccgggcgtatgcgccgaaattgcgggtgccgagttgattcatcttgtggtgaactacgcttaattcctgctcgttcaggcagatttccttgcggatgggtcgtgtgcggtctggcatattgaaacactcctttcacaatacaacggacattttttctcaaaaacttggtagtgacgaaaagaaaattttgaagacgagggcattggcgattcgttgcccctcactttacaacggacatttttaagtcaaaacgcaggtattgaaatgcgaaattttcaaaaaaatttgcgctcctgcttttgcgaaagcgggagcgcattgtatctgcggatatgagatttgggagagtagcaagcacatccggtgtccgtacacactggaaaaatgagcggttcagccctgcgtccgaactgctcattttgttgttggggaatccccacacccctttcgtgtcgaatttgaaaatacttcctgaacttttcgggaaagcccttgcttttattcgctttgacgattataattatactgtgattttataagcagacgcagaaatgaactgcaacaggagtaccgcccatgaagtatttatctatcgcgcaaaccgccgaacgctggggcatctccacccgccgtattcagatattgtgcggcgaggggcgcgtcccaggtgctatccgcattggctcggtctgggggatcccagaggacgcagagaagccagcggacgcgcgaatcaagaacgggaagtatatcaagcaaaaatcagaatgacaatttaggaggttgttgtatgccacaagaggccgcgaatgttatgaccccatatgaaataattgcgacagttattgctatattggcgttgctgcaaccatggattataaagctttgggatcgctttggtcgaaaaatccgtgtaaactttatcccttcggcaaaaataaaactttactataaccgtagcggtgcttatgtttatttgggtggtgttattgaaaccaaaaacaaagcagccattgttaaagatattgcagtcaaagttgttcgtaaaaaggacaaggctgaattgctgctggattggtcttcttttatgattcctgtgtttcaatctgttggcggcaacgcagtaacaaccagtgaaatcgccagaccatttaaggtggaagcaggtagcctctatccggtattcgtagaatttgcttcaacaaacattcaagagagcaatcatctgactgaaatctataacacgatagctcttgaacttgctcatattatgcaaccaagcattacaatcgatcaagccaaatatgcacttgccaattcaagcagctaccaagcttttagagatgagcttttgcagaacttctattggaaagcggatgactacgtaattgagcttacaattacgtacaacgatacgaaaactcagcagtataaattcaagttcagtatagatgccagcgaagctgctgctttcaaaggaaatatcgaaaaatctctgcaatgtgcagtggatgaattctacagagttcccactaatttattctacccacagaaagattttgtccttgatgacggtcaataagcagttaaactactctgactcgaaataatggggtctattccatcccgcgggtgcgaatgggcgcactgacctcttgtcacgaatctacctgaatcgtcgattcgacaaacgatgacagcgttggacaaggatttagtccttccaagacaggataggtctttcaccacaataaccgctatacagacatagccagaagtgaccctcattactgctgagggtcagggcagaaaaccctcatttgaaatgaggataacacgattacggaggaaatcagccatgccaacacttgaatggattggaaaaagcaaggtgatcaatcaccatcaggacgtgccgtttcgggtgttggagcgcaagtacagctttgatgaaaacggacagcacgatgaggataacggcagcgaaaacatgatcatccggggcgacaatctggaagccctgaaagccctgctgccccggtatgaggggcgcgtcaagtgcatttacatcgatccgccatacaacacagcaaaaagttccgaaaagaacaaagcatgggtatattcagacaatgtagatgaccataaaattcaagcatggattgacattactgttgggaacgagggtgaagatctcactcgacatgataagtggctgtgtatgatgtaccccaggctaaagctactatacaagttactggctgaagatggaatcatctttattagtattgatgataatgaagcagatacactgcacatggtatgtgatgagatattcggacgcagaaatttcgttgcgcagcttgtatggcgttctgacgggaattttgataatcaggcaaaaattaaaatatgccacgaatatatcctctgctatatgaaaaaccctgatcttttggggttgccatctggtgttgatccaaatgcgactgagaaaagtaaaatctataatgatgagattcgcaacaccgttgtaaaaaacggccctaagaatccaatgtccaaagtagaattgccccgcggttttccttgttctgtctcagatttagtgattgagccgaggcacgactcttttccttattactatcagcgtgccactgtcgttgacggtaaactgacaggggcagttacggtagaaagcggatggtcatcgaaaaatattttacaggcattcattgataacggctttaagcctgttcttgatagtaaaggtcaatttacaacttttgagatcacaaagacaggcgctattgagatggtaaaaaagcgtgaaacggttagccatgttctttcggttttgtcgaatttgggaagcacacagaatatgagtaacgagttagcccatatgggaatcagttttgattttccgaaaccggtacagcttattcaatacttgctcggattttatagcaaagaggattccattattctcgattcctttgccggttccggcaccaccgcccatgccgtcctcaacatgaacaaggcggacggcgtgcaccgcaagtttatcctcgttgagatgatggactacgccgacagcatcaccgccgagcgcgtcaagcgcgtaatcaagggctacggcgaggggaaaaacgccgtggagggcacgggcggcaatttcagcttctacgatctgggcgaaccgctgtttgtgggcgattgcctgaatgaagccgttgccccggagaaaatctgcgaatacatctggttcatggaaaccaagcagccttacgccccgcccagcggtggcaatccctattatctcggcaagcacaacagcacaggctattacttctactacgagccgcagcacgtgacggtgctggactatgcgttcctctccaccattacggaaaaagccgatggaacggtgatctatgccgaccgctgttccatcagtgaggacaagctggtaaaaatgggcgttacattcaagaagattccgcgcgatattagcagattgtaagggggtgttcgctgtatggaactgaaatcttatcagaaaaaagtgatagcggacttgacccgctatctggaactgctgaacgaaacaaggagtgacgcagcggcgtttcgcctgttctggcaggagaaatcagccccgactttagggctataccaaaacgtgatacccggtgtcccgaacctctgcttcaaggtgccgacaggcggcggcaagacctttattgcctgcaacgccgttcgtcctatctttgacgcgctccccgctaccaagacaaaggcggtcgtgtggcttgttccgtcggacgcgattctgacgcagacggcgaaagccctgaaagacacctcccatccctaccgtcagaaaatcgacgtggatttcggtgggcgtgtggaggtttacaccaagcaggagcttttgaacggtcagaactttaaccccaccgccgtaacggagcagttgtcggttatggtgctgtcctacgattcgttccgtggtcgcggcaaggaggtcttgaaagcctatcaggagaacagcaatcttgccgagtttgcaaaagtgctgggcaagcctgacagccccattgaaaaagcggacgaaaccgccctgttccagattatcaaccagcttaacccgcttgtcatcgtggacgagagccaccatgcccggtcggaattgagccttgaaatgctggaaaacttcaatccctgctttgtgctggatttgaccgccacgccgaaaaaggagagcaatatcatttcctatgtggacgcggtgcagctgaaaaacgaacacatggtaaagctgcccgtgatcgtctataaccgggacagccaatccgaggtgctgattgatgcaatcgacctgcggaacaaactggaagaaatcgcaagcgcggagtacaccaagacgggcaaatatatccgtcctatcgcattgttccaggcacagccaaaaggcaaggaggacgcgaccacctttgaaaagctgcgggacaaactggtggacaagggaatccccgccgagcaaatcgctattcgcaccgccgatgtgaacgaactgaaaaacaccgatttgatgtccccaaactgcccgattcgctatattatcacggtcaatgcgctgaaagagggctgggattgcccctttgcctatattcttgcgtctcttgccaataagacaagtcaggttgacgtggagcagattttgggacggattctccgtctgccccatacgagccagcatacgcagagcgcactcaatatgtcctatgtgctgacttcttccaacgacttcaacaatactgtggcgcatatcgtcaagggcttaaacagcgcgggcttcagcgataaggactatcggatcggtgagcctgcaagaccgaaagcacccgaacagacagcagagcaaatcacgctgcctgacccgcaagaagcttccgaaccggaaagcgcagaggacgattttgcatggctggacgataaatctattgacacagagttggaacggcgcagagaacaggcaaaaacgcctgaaactgccctgaaagccgacaccatgctggacgctgccgcagaggtcgaaaaggcgtacacagacgctatccaacagaccggcaatgatccggtgatggacaatcttccgtgggaggtacgggataaagtgaaatcatttcaggtaaatccgcagttccgggaggatattgaaacgctgcaaatcccgcagtttttcctgaaagttgagcaatctttgtttacggacggttcttttgaattgctggacaaggaaatgctggcagagggctttaccctcaagggcaaggcatacgatattgactttgccgccgcagacgatgaaatccgcgaaatcgacgtgcgggagcaggacggcggtttgccgaaggtgttcaagatggagagcgccgagcagcggtacttcaaggagtggttcaacaatctgccgccggaaagccgggtacgtcaatgcaaggatatgatgttcaatcagcttaacaagctgaatatggtggatgccgccgaactgaaagcctacataaaccgcattgtggacgatatggataaggcgcagcttgccgctatggagaaagccccgttgggctatgcggcgaagatccgtgacaagatcgaaacgctgctggaagcccactatcgggaaacttttgataaatggctggaaacggaacgtatcgtctgtatgccctcgttccgtctgcccacatctattcatcccgccagcaatacagccatatacgcccgttcgctgtacacggcggaggatggcgacatgaacaagctggaacagaagctgattgtggagttgaccgccctgccgaatgtccgctggtggcacaggaatattgcccgtcagggttttgcaatcaacggctttatcaagcactaccccgatattctgattatgaccaaaagcggcaaactcatttgcgcggaaaccaagggcgatcacttgaaaaacgacgacagccgggagaaaatcgcactcggtcaagcgtggagcagtcatgcgggaagtcagttccggtactatatggtgtttatggatgataacgatctccccacgggtgctgtcagtatgagcaagttcttagaaattttgaaggcgttgtaaaagaggtgaggatttgtaatgtacatatatgcccatataaacaaaaacaccttgcgctttgtacgtgaacaaaaagccatatctttcgattatgttacacgtatcacaaaattcaaggaagataagctgacgttatgggaaagcaatgattctggcaaatttccaacaataaatcaagcaaagactattgcaaagtgttaccgcattccatttgcagggttatatatgaacgcgcaagatattaacataaagcacctgcccaaaatgcgaaatcttcgatctttgcctaatgcaatagtcgataatagtgcattgaatcttgcgattgccgatgttctctctgcgcgcgagcttcttttagaatctaaaaaagcgttaaaggaaacagtcgttcaattcaatatgtcaattaactgcccagacgataatgttgctcaatgggcaggagaaatacgaagaacacttggaattgattcaaatgttcaatacaaatgtcggagcgcaaggcaattatatttatatatacgcaatcttgccgaggctgctggtgcgtttgtccattgtttcaccggcgtagacaccgaaatcgttcgcgggtttgcgatatatgaggatttaatgccaatcatcgggttgaataacgatgacaggtatcctgccaagaccttttccattattcatgaactcgtccacttaataaaacgtagctcagcggtttgtaatgatatgacaaattctctttctttgcaagctgaggaagtattctgtaatgcagttgcaggagcagttcttgtccctactgtaaatttgagtagacaacttggtgaatatacccacgacgaaattgacttagatgtcgtttcgtcattagcagacaagttttctataagcaaggaagttatatgtagacgtctattagataccggaaaaatcacgcagcaaagatattctcagttgacaactgcaattagattgcaatttgaaagcgagagaaaagcagctcaggaatatcgaaaaataactgggcaagtgattccacgaaatatgtcgcgggaagcaattgaccaaaacagttccgcactatgtcgtacattttttcacgggtatagggagggactctttgacaaacaagacatatcccgctaccttggtgtaaagcaaaaccatgttgataaatttatatgggaggtatcgaagtggtaactaattcttctctgacaaattatattatcgacacatcttcgatcctctcgcagaaggatgccgagccacacagacggacaattaacaagacgctttggcagtatattgacaacttgatcgagcaacagcgaattgtcacttgctcagagataattgaagaagtaaatgatgaagtcctaaaaaagtggtacacaggattgcacggcattatattgcccattgatgatgaagttcaggagaatgtgaaaaaggtagtcacatcgaaccctcagctcattgatttcaagcagataaaatcttccggagatgcgttcttaattgccacagccatgaagtatggcttgacaataataaccgaagaaagcaaaaaaggagaaaagaagattccatatgtctgccaaaaattaaacgttccgtgcgtagatattttgggactgtgcgaaaaagaaaaatggcagttctaattgaccttattgtgtagcagttactatcgcttcactatatctctgtaacgtactgattggaaaatagaacgacagagtgttatgaaacccacctctcccttttctccctcgctgcggctatggaaaccgtggaaaaccgcaagcggttttcgcaccgttcccacagcctgctctcaccctctttttcctctctgactttctccccatacagagaaaagttttcatttttactccaagagcgcgcagttaccgtgatgggtagagcgcagtatgtcaatacggcatagaaaaacgaacggcacataggcgattttatcctcgaaagaagccccgaaacgcaacataaaagaagcccagcaccacgccgtttgacgtgatgctgggctgttcctgattacaacgattttcagcggatgaagcaatgctctgcttgcagatagctctttcgcattttgctgcatggcgtgggaatgtactgtttcgcaaaatctcatgcgcagaagtgtaccgtgtacactccatcgtgctttactttccgatgtgcttttttcgtgcagggagaaagaactttactgttttcactacactcgattttagcacggcgtttttactgccctcacagtcgatttactctgaaattaagccaaaatgccgcagcgcatccttgattgcctcaaccttttcgggcgggcagggatgatactcatgttttctctgctccaccgcattcggtgctttgtgcatatccagtccgaccatacgttttacctcggcaatatatgccgtatggactttgaagccgtacttttcctgcacatactcctgaatacgcttataggtcggatgctccttaacctcgccggtttccacttccattctgacctcaaccgtcagtggatttgtttcccgtgacaagaggacaaccgtctccacatgcgcggtgcgggggaacatgtccaccgccacggcccttttgagggtgtagccccgcccggcgaaccgcttcacgtcccggcccagggtgccgggatcgcaggagacgtagaccacccgctgtgggcccatgtccgcgatggtgtccaccacgtcctcggccagccccttgcggggcggatccacgcacaccacgtcggggcgccccccctccccctccaggtagcgggcggcctcccccgcgtcggcgcagaggaagcgggcgttttcaatgtggttgcgctgggcgttggcgatggcgtcgtccaccgcctggggcaccacctcggccccccacaccatgcccgccttccgggccatgaccaggctgatggtgccgatgccgcagtagagatccagcaccgtctccgccccggtgaggccggcgaactccagggccttgccgtagagcacctcggtctgggccgggttgacctgataaaaggaggggacggacagccggaaggtgaggccgcacagggtgtcggacaggaagtcctccccccacagggtgcggtaggagtcccccaaaatcacgttgttgtgcttctcgttcacccccagcacgattccggccaggttgggctcggcccggcgcagggcgcgcaccagctcggcctcccgggggacgccccggccattgaccagcaggcagcacaggctgcggccggcccggttggtgcgcacatacacgtgccgcaccaggccggtgaaggtgcgctcattgtaggcggggatggagtactccgccatccactccttcacggccccccgcaggcgggcggccgcctccccctggagcaggcagtcgtccacgtcgattacgtcatggctccgggggcggtagaagccgatgcgggggcccttggccaccggaaactgggccttgttgcggtagcggtctacctgctccgcccccaggatggcggagacgtggatctccgccccgcccaggcggcgcagggcgtcctccacccggatgcgcttggcctccagctcctcggcgtagttcatgtgccggaactggcagccgccgcacttggtgtagtgcaggcaccgggggaagatgcgggcgggggaggggttgaccacctcctccacccggccccagagggcgctgcggcccacatgggtgaggcgcacgtcgcaggcctctccccggatgccgccctggacaaagactaccatcccatccagccgggccaccccggcgccgtcgctggcgtagccgttgatcaccaggcggcagagctgcccctcccggggcttgccgttatccatccgcactcacgtccttcatggcgtcataggtcagcaccgcagagagcgggctgttcatggcgggcagggcgccgccctggagccagaacacatacccctccgccgtacagtaaaagttgtccacctgcaccgcggcggtgatggcgtcccgggtgagcgtcccctgctccaccgccgcggccagctcgctccgctggtccaacagggcgtccaccacccgcgcccgtacggcgtcggcgtcggtgaagaagtcggtgaagtccagcttttcccccatcacggcgtcaaactgctcactgagcagaaagacggcggggtgggcctccccctcgctggacacatacaggtcccggcagacgctgatcaccttctcgtcggcgtaggcgatctggtaggtcatctcctgggtggtagggtagaaggggaaccccgccgccttggacacgtcgtagtcggccaccgccatctcataggcctcctctgcctccagcatccggctggccccctcggccttgtaccactcgttgatggccgccccggcggggcaggcgtcggtgttctgtatcagcgggagggtgaaggaggcggtgagcaccgtggcgccgtcgccggaggtaaaggtcttggcaaagacctgatccccccacttgggagcggcaggcgccggcgtgggagtgggggtgggcaccggcgtggatgtctggatgggggtgggcaccggggtctcctccggcatcttgtccccgccgcaggccgtcagggacagggtcagcgccgcggccaacaggccggacagcacaatccgttttttcatattacgctcctttacactgggtgatgggaacaacattattgtaccatctgcctgccgggccgtaaatggaaaaaagcaatttgtaaccttccgtatttttttggtataatggacgaatcacagcgggaggcgcggcggcctggacaacaactatgggcccggtgccctcatctacgccccctgcgtgctggcgccgcaggcgcgaaggaaaaccgcaaaacgctgggtttgttcataatttccccttttttattgacatgggatatgatatactaggaaactgaattagcatccaagtcctgggagccgaggcgccggggacaggaacaagaaaggtgaacaagacgcatgggactgttgaaaaagctctttggcaccagctccgagaaggagctccgcgccatcaaacccatcgtggacaagattgaagccctggacggggagtactccaagctcaccgacgagcagctcaaggccaagacccccgaattcaagcagcgcatcgccaatggcgagagtctggacgacatcctgcccgaggccttcgccgcctgccgggaggcggcctggcgcgtgctaggcatgaagccctaccgggtgcagctcatcggcggcatcatcctccaccagggccgcatcgccgagatgaagaccggcgagggcaagaccctggtggccaccctgcccgcctacctcaacgccctggcgggagagggcgtgcacatcgtcaccgtcaacgactacctggccaagcgcgacagcgagtggatgggcaaggtctaccgcttcctgggcctcaccgtgggcctggtgatccacgacatccagcccaaggaccgcaaggcctcctacgccgccgacatcacctacggcaccaacaacgagttcggcttcgactacctgcgggacaacatggccatctacgccaccgagatggtgcagcggggccacgccttcgccatcgtggacgaggtggactccatcctcatcgacgaggcccgcacccccctcattatctccggccagggggacaagtccacccagctctacaccgtggtggacgcctttgtggccaagctcaagggccagcgggtggccagcgtggacaccaaggaggaggaggaccccgatctggacgccgactacgtggtggacgagaaggcccgcaccgtcaccctcaccgcccggggcatcgccaaggccgagcagcagttccaggtggccaacctggccgatccggaaaacaccaccctgtcccaccacatcaaccaggccatccgggcccggggcctgatgcgccgggacatcgactacgtggtgaaggacggcgaggtcatcatcgtggacgagttcaccggccgcctcatgtacggccgccggtactccgagggcctgcaccaggccatcgaggccaaggagggcgtcaccgtggcccgggagtccaagaccctggccaccatcaccttccagaactacttccgcctgtacggcaagctctccggcatgaccggcaccgccatgaccgaggaggaggagttcggcaccatctactccctggatatcgtggagatccccaccaacaagccggtgcagcgcgtggatcaccccgacgtggtttacaagaccgaggcgggcaagttccgcgccattgtcaaccagattgaggagtgccacaagaagggccagcccgtgctggtgggcaccatctccatcgagaagtcggaggagctctccgccatgctcaagaagcggggcatcaggcacaacgtgctcaacgccaagttccacgagaaggaggccgagatcgtcgcccaggccggcaagctgggcgcggtcaccgtggccaccaacatggccggccgcggcaccgatatcatgctgggcggcaacgccgagtacctggccaaggccgagctgcgcaaggccgggctctccgacgagctcatcgccgagtccaccggctacgccgacaccgacaacgaggagattctcaacgcccggaagatgttcgctgaggcggaggccaaatacaaggacgagatcaaggcggaggccgaccaggtgcgggccgcgggcggcctgttcatcctgggcaccgagcgccacgagtcccgccgcattgacaaccagctccgcggccgtgccggccgtcagggcgacccgggcgagagccgcttctacctgtccctggaggacgacatcatgcgcctgttcggctccgagcgggtcatgggcatgatggagaagctgggcgtggacgaggacacccccattgacgcgaagatcctctccaacgccattgagaacgcccagaagcaggtggagtcccgcaacttccagacccgcaagaccgtactggagtacgacgacgtgatgaacacccagcgtaaggtcatctacgagcagcgccgcaaggtgctggacggggagaacctgaaggagtccgttcagaccatgctctccaccgtgatttccaccgaggtgcaggcccacatgggtgagctcaagcacatggacgccgagaactggcgggaggtgtgcgcccagttccgcggtctgttcctgcggcccgacgagttcaagtttaccgacgaggagctccagcagtacgacgcccaggccctcaccgacctgctccaggagcgggccagcgacatctacgcccgcaaggaggccgagctgggcgagcccctcatgcgcgagctggagcgggtgatgatgctccgggtggtggacgagtactggatggacaacatcgacgccatgcaggagctgcgccagggcatcggcctgcgggcttacggccagaacgacccggtggtggcctataaaaaggaaggctacgagatgtttgagagcatgatcgccgccatccaggccgagaccatccgccgcatcttcctggcccgggtccaggtgggcgccaccaccgtcaagcgggagcgggtggccaaggtcaccggcgagagcgcgggcagcgacggcaccgttaagaagcagcccgtcaagaagggccagaaggtgggccgcaacgacccctgcccctgtggcagcggcaagaagtacaagaagtgctgcggcatgcacgaggacgagtaaaagcagtctatggggtatccaaaagcggaatggggcttcgctggcgtttgaccggaagcgcctccggcccctagatacaaaaccgccgtgccgctttgcggcacagcggttttgatacccccggcttcgtgcccgcggcgcgggtcgaggtgtttttcgaaacgcgagtttccggaaaaaccgatttcgatttccagatggaggaaatccatgaatatcatcgagcacaacaaaaatggcctggtgtatctcaccgccgacggctttgaggccgccggcggtgtggcacacggcttctccacccgcctgggcggggtatcggaggggatctacgccaccctcaacctgggcatgaaccggggcgacgctcccgaccgggtacgggagaactaccgccgcttctgcgccgccattggggcggacatggggaacattgtctgcgccagccaggttcacggtgacacggtgcgcaccgtcaccgcggcggatctgggcatcggcctggacgagccggagccttggcaggcggatggccttgtcaccgacatccccggtgtgacgctggcggtctactccgccgactgcctgcccatcctgctctatgacccggtgcgccgggtggtgggggcggtccacgccggctggcggggcaccgccctgggcatcgccgccaaggcggtggagcgcatggtggactgctacggctgcgaccggctggacatcctggccgccgtcggccccggcatctccaagtgctgcttcgagacccacgaggacgtgcccaacgccatgaccgaggccatgggggccgccgccctgtcctccatcgaggtgctgcccaccggcaagttccacgtggatctcaagggcctcaacgccaagcggctggagaacgccgggctggaccccgaacacatcgctgtctccgccgactgtacctgctgcctgccggagaagtactggtcccaccgctacacccacggggagcgggggagccaggcggcaatgatcgcaatcgtctagggggcatccaatggcgtctgaggagactccgtctggacttcatcggaagcgccaccggcgcttccgacccctagatacgagcctgcgtgccggcgaaaacgccggcgacttggctcgatacccccggtttcgcgccctgtggcgcgggtcggggtgtctttccggaaaatgaattcccggaaagactgattttcaatttcgtttccccgcagggcggggaaaacgctgtgagataagcagctataaaatatggatgctccattgccgttgtacgccaatccaaaattccctcggagagcggagggggtatcgcgccgcaggcgcgtatctagggggaactggttccctctggaaggcgcgtatcctgccgcgcagcggcagagattttccgcagaaaatcgacgcgcctttaggaaggaggccgagccgtttgcgaaacattctagccgccctgctgacggcagccctgtgcctgggtctggccgcctgtgggccgtcgccggagccggagcccacacccacccccacgcccagcgtctccccctctccagaggcggccgagttcgccttggcctgctacccggaggccgggttccaccccatcaccggctccaaccgcaccaacctggccctggggggcctgctgtatgaggggctgtttgccctgaacgggcagtttcagccccaggaggcgctctgcgcctccgcctccgtgtcggccgacggcctccagtggtcctttatcccccgcagcggggtgaccttctccgacggcagccccctgacggccgcggagatcgcggcctccctcaacctggcccgcaccagccccctctactccgcccgcttcgccggcgtgacggacatcgccgccgccaacggcatggtgaccgtcaccctgagccgcgccaacggtgctctgcccgccctgctggacatccccatcgtcaaggagacgggaggcgtccccctgggcacggggccctacgtgctcgccggcacgggggagaacctcgcgctggaagcccgctccgactggtggcaaggcaaggccctgccccgggacaccattcccctgcgggccattcaggaggcggacgatctgatccatgcctttgatacccgggacattgccctggtctccaccgacctgacgggcaccaatgccctgggtttttctggttcctttgctgcggtggactaccccaccagcaccatgctgtacgtgggcttcaacacggccgacggcccctgccggagcgcccaggtgcggcaggccctgctgcggggctttgaccgggccgccgtatccaccgcccagttctcccgccacgcccagcccgccgcccttcctgtctcccccgccagccccctctacgacgaggcgctggcccagacgctggactacgccccccaggccatggagccgctcctcaccgctgccggctataccagagccgacggggtatggcagaaggaggggcggccgctggcgctcacctttgtggccccaaacaacaacgccgaccggctggccgcggcggagacgctggccgccaacctgaccgacgccggcctggaggtggagctgcgggccctggcctgggacgattaccttcaggccctgacggcggggaacttcgacctgtacctgggggaggtgcggctcaccgccgactttgatctcaccgccttcctgactcccggcggcgccctcaactacggcaagtatagcgacgccggggcgctgaaccgcctgagcgccttccgggccgccgtgggacagtggcggacggagccggcccggcagctctatgaatatctggccgggcagccccccttcgcggtcatctgcttcaagaactggtccgttttgacccagtggagccggatcgacgggctgacgcccacccagcaaaacatattccatcaattttccgactggaagatcacataagggagagaaagagagtatggggaacgtatttcgctgttatgtggagaagaagcccggctttgccgtggaggcggagcatctgttcggagagctgcgccacaccctgggcctgacggggctgaccggcgtgcgggtgctgcgccgctacgacgtggagggggtggacgcggcggtctatgccgccgcccgcaccaccgtgctctccgagccgcaggtggacgccctgtgggatgaggtcatgcccgccccggagggggagcacaccctgctcgcggtggaggccctgcccggccagtacgaccagcgggccgactcctgcgcccagtgcatccagatgatgcacggcggggagcgccccaccgtccgcgccgccaccgtctacgtgctggagggggccctcaccgcccaggaggcggccaaggcccgcggctacctcatcaacccggtggagagccgggaggcggcgctggacaagcccgccaccctccgccaggactaccccgttcccgccgccgtgcccgtgctggatggcttcaccgccctggaccgcgcgggtctggagagcgtgctggcccagtacgccctggccatggatctggccgatctcgccttcctccaggcctacttccgggacgaggagggccgcgatcccaccctcaccgaggtgcgggtggtggacacctactggtcggatcactgccgccacaccaccttctccacccatctggacgaggtggagatcgccgatgacaacgtaaaggccgcctatgagcggtacctgtccgcccgggtggaggtctacggcgcggagaaggccgccaggcggccccagaccctcatggacatcgccaccctgggcgccaagaccctgaaaaagcggggcctgctccccgggctggacgagagcgaggagatcaacgcctgctccatccacgtgcccgcccaggtggacgggaaggagcaggactggctgctcatgttcaagaacgagacccacaaccaccccaccgagatcgagcccttcggcggcgcggccacctgcatcggcgggtgcatccgcgaccccctctccggccgggtatacgtccaccaggccatgcgcctcactggctgcggcgacccccgcaccccggtggagcagaccctggagggcaagctgccccagcggaagatcgcccagaccgccgcggcgggctactcctcctacggcaaccagatcggcctggccaccggccacgtggcggagctctaccacgagggctatgtggctaagcacctggagtgcggcgcggtggtgggcgcggccccggcgtccaacgtccgccgggagcggcccgcccccggcgacgtggtgatcctcctgggcggccgcaccggccgggacggcatcggcggggccaccggctcctccaagagccataacaaggccagcctggacactatggccagcgaggtgcagaagggcaacgccccggaggagcgcaagctccagcggctcttccgcaatcccgccgtcacccgcctcatcaagcggtgcaacgacttcggcgccggcggcgtgagcgtggccatcggcgagctggccgacggcctgtccattgatctggacgcggtgcgcaagaagtacgacggcctggacggcaccgagctggccatctccgagtcccaggagcgcatggccgtggtggtggccccggcggacgtggacgccctgctggccgccgccgccagggagaacctggagtcctacccggtggcctcggtcacggcggagccccgcatggtcatgacctggcggggccagaccgtggccagcttgtcccgggccttcctcaacaccaacggcgcggccaagcacgcccgggtgtccgtgccccaggcggacgccgccccggagagggcggcctgctccaccctgcgggagatggccgccagcctgaagtgcgcctcccgccgcggcctcaccgagcggtttgacggctccatcggcgcgggcagcgtgctcatgcccttcggcggcaggacccagcgcaccccggcccaggtcatggccgccctcttccccgtggagccggagcaggagaccggccaggccagcgtcatggcctggggctgcgaccccgaggccctgtccgccgacccctaccagggggcaaaggacgcggtctacgcctccgtagccaagctggtggccgccggcgcggactaccggaaggcctatctgaccctccaggagttctttgagaagctgcgggacgagcccgcccgctggggcaagcccttcgccgccctgctgggggccctggacgcccagttggagctgggctgcgccgccatcggcggcaaggactccatgtcgggcaccttccacgatctggacgtgccccccacgctgatctccttcgccatcgcgcccatccaggcgggtgaggtgctctcccccgagttcaaggaggcggggcacccggtgtacctgttcgtaggcgacgctctggccgagcaccctctggcggcctgggacaagctccgtgaactgcacaaggccgggaaagtgaagtccgcgtgggcggtggagcacggctttgccgaggcggtcatgaacatgtccttcggcaacaagatcggctttgccatgggttccgatgtggacacgaactggtacactccctggccccgctccattgtggcggagctgaccgaggagctcgacttccccctggcgatcaggctgggcaccaccaccgccgagccggtgatcaccatcggcggcgactccgcccccattgacgagctgctcgccctcaacgagggggtgctggaggacgtgtaccccacccgggcgggggagtccgccccggcgcgcaccctctcctgggacaagcgctccccggcggtgtgcaagtccaaaaccgcccggcccagggtggccatccccgtgttccccggcaccaactgcgagtacgactccgcccgggcctgcctgcgggcggggctggagccggagatcgtggtggtgcgcaacctgaccgcctccgccctggaggagtcggccctggccctggaaaaggccatccgcgcggcccagatcctgttcctgcccggcggcttctccggcggcgacgagcccgacggctcggccaagttcatctgctccttcctgcgcaacggccggctcaccgacgcggttcacgacctgctcaagcgccgggacggcctgatgctgggcatctgcaacggcttccaggccctcatcaagctgggcctggtgccctacggcgagatccgggccatggacgagggctgccctaccctgaccttcaacaccatcggccgccaccagagccggtacgtcaccacccgggtggcctctgtccagtccccctggatgctccagtcccatgtgggcgacctccacgccatccccatctcccacggcgagggccgcttcacagccccccaggcggagctggagcggctgatcgccaacggccagatcgccacccagtacgtggacgcctccggcgcggcctccatggacatcgacgccaaccccaacggctccctggaggccatcgagggcatcttctcccccgacggccgggtgttcggcaagatgggccactcggagcgccggggcccctatgtaggcgtcaacatccccggcgacaagcaccagcccctcttcgagagcggcgcggcctacttccgttgatgcaaaaatccccggcgcgctgcgccggggatttcagcctgccgaaaatgtcttttcgtcaggctgccggactttttgaacctctaaagaggctcaaaaagtcgtttgatcccacgcgaaagggaaccctgacggttccctttcacactttccctccctccgaactctttgacatacagctttaccgcctgtctctaatccccggcgcggtgcgccggggatttcagcctgccgaaaatatattttcggcaggctgccggactttttgaacctctaaagaggtttaaaaagtcgtttgatcccacgcgaaagggaaccctgacggttccctttcacactttccctccctccgaactctttgacatacagctttaccgcctgtctctaatccccggcgcggtgcgccggggatttttcatctgattttaagaatgcctttaggacgcttttatctgggtgtgataagctggtaccatcaaaaggaggactgattccatggttacgctgttcacactgggcatcatctgtctggccgctgtgattctcattcccgtcatcctgtttctggtgggcctgcccttcctgctgctcatgggcctgctgccctggctgctgcgcgtcgcgggcgtggtgctgctcatcaaggccctgctcgacaagcccacccgctgggaaaacttcatgcccgccgtcgtggcctttgccctgtccctgctcatcggctggatcttctgagcgccgggcggcccctacccgtccagcggctcggcccgcagggccgccccggagccggtaacaccgtaaaaggcgtactcgtccggccgcagggtggaggcggccagggcggcgcgcaccgccgccccgtcctccggccggaagcgcacggcgatgccgcagcccagggagatctcccgcagcaccggcatggtgagcacatccgccaccggccgcagcaccttctgggcgtagatggccccgtaggtggaggtgaaggtgatcacgccgtagtccattacagggagaccaccttggccgcccgctgcatgcgggtgacgatgtcgtacatgttgctcaccgtgcccacctggagctggtcggtgaggccgtagaagctgaggcaggtgccgcacaccaggatctcgacgcccgcatcggccagggccttcaggtgggcgggaatctgctcgtccagggtgggcaggcgcacgccggcgttcatgaagagcaccgcgccgggcttgtcctccccctgggccagagtgtagaagaacatgcgcatcaggttggcgcccagctcccggtcgccgtccccaatgatatcccggcccacaaacacggcccagtctccgccgggggcgggcaggggagcgctcaccgcctcctcacaggcggcgcagccggtacgggtgaaggccacggaaaacaccccctccccctgggtgacggcggccccgaacccctggttgcccgccaggcgcttgaggttttccaccgccgtggtgttgtccaccagcacggtgaaggaatgttccccggcggccatggcctgcttggccaggatgaccggggtggggcagggcttgcccttggcgtcgataatcgtagacacgggctcacatcctctctcattggtgagcccattataccgccggagagggcaaattgtaaagaattcttgaagaatgcggaaggcggacggccttccgcttttttatcggccccatttgtgctatactgctgtatattccaacgaaaaggaggtgggcggatggaggcgctgctggactggatggccgccaatccccaggtctgggcttggttcaccacggcggtgcgctttttgttcccggtgctggccctgctgattctcatacggacgatccgctccctgctcaccgtgccctgtctgccggaggtgtgggcctacctgaccctgcccaacggggcgcaggagccgctgacccactgggagaacattctcggccggggcggcaactccgacgtaatcctcaactaccctgtggtctcccggcagcacgccgccctgattcgccaggcggacgacacctggacggcctacgacctgggctcaaagggtggcgtgacggtaaacggcaggccggtggagggctccgcccccgtccagtacggcgacgtggtgggcatcggcggggtggagaccgtgctgctccccctctctccggaggaaaaggcccagcgccgccagcggcggcgggcctggcggcccgtgtccccctggctggggctggtgctcctcaccgtgttccaggccctcaccgcactccagctcaccatcagcgagggggagaacgccacggtgatgatcccgctcaccttcctgctgctgacgggggtgatgtggctgtacttcctcaccctccgcgccctgcgccgggtaggctttgagatggagaccatcgccttcttcctgtccaccctctccctggcggtgacctcctcctccaatacccccgccctgttcaagcagttcctctgcgtggtgctgggactggccctgttcctggtgctgggggtcttcctgcgcaacctggaccgggccaagaaaatccgctggctcatggccgccggggccatcggcctgctgagcctcaccgtggtgctctacctgctgggcctcaccggcaccaaatatggagcggccaactggctgaccattgccggcatctcggtgcagccctcggagctggccaaaatctgctacatctttgccggggcggccaccctggaccggctcttccgcaagcggaacctgggcctgttcattctgctcaccggcgtgtgcctggcctgtctggcctatatgagcgacttcggcaccgccgccatcttctttgtcaccttcctggttatcgcctacctccgctccggcgactgggccaccctggccctcatctgcggcggaggggtgtttgcggtgctcaccatgctctccctcaagccctacatccttcagcgcttcgccacctggggccacgcgtggcagaacgcctcggtaggcagcggctaccagcagacccgcaccatgtcggccgccgcctccggcggcctggtgggggtgggccccggcgagggctggctccacaccgtgggcgcgggggacaccgacctggtattcggcatgctgtgcgaggagtgggggctgatcatcgccctgctggcggtgctgtccattctcactctggcggtgttcgccgtccgggcctgccgggccggacggagctccttttacgtcatcgccgcctgcgccgccacctccatgatggtgtttcagacctgcctcaacgtgttcggcgcggtggacattctccccctcaccggcgtcacctttcccttcgtgtccaacggcggcacggccatgatcgcctcctgggggctgctggccttcctcaaggccaccgacacccgtcagaacgccagctttgccatccgcctgccctcccggcgggaggaccgccggggggcggcgctggcccccaaatccaccgacgaatgggaggcggacgatgaagaagattgaaaagcgggccctgctctgcctcctgctggccgccgccctgctgctgggctccggcctgtttgtgttccgcttcgtgaaaaatggcggccgctgggtctcctttgccgccaaccgccacctctacaaccgccagggacagctctcggtgggccgggtgctggaccgggacggggacgtgctctcctggacggaggaggacggcgcccggcgctggtacgacaactccaccgtgcgcaaggccaccctccacgccgtgggggacgcccagggcaatatcggtaccggggcgctggtggcctttgccgaccagctctccggctacaacctgctcaccggggcctactcccccctgggggcgggcaacgacctctacctcaccctggacgcccggtacaactacatcgcctatgaggccctggccggccgcaagggggcggtgggcgtctacaactacgagacgggggaggtgctgtgcatggtgtccacccccgcctttgaccccctgtatcccccctcggcggaggagatggagggaaacgacgcctacgacggggtgtacctcaaccgctttctctccggcaccttcccgccgggctcggtatacaagaccgtggtgctctccgccgccattgagcgcatgcccgacctctttgaccgtacctggacctgcaccggctccacccaggtgggggacggggccatcacctgcccccgcgcccacggggaacaggacatctcctccgctctggccaactcgtgcaacggggtgtttgccctgctggccgacgagctgggggaggacgtgctggaggagtacaccgtccgggcggggctcacctcctcctaccgggtcagcggcctgaacaccgccgccggctccttcgattttgacggcctcacggccaacgagctgggctgggccggcgtggggcagtacaacgacctggccaacccctgcgccctcatggtctatatgggagccatcgcaaacggcggaacggcggccgtgccccggctggtgctcaagacggagaacgccctgggcctgccgtccctgcccgccctgccccggcacaccaaaaagctggtggagggggataccgccgccgccctggcggagctgatggcccacaatgtcacggctcagtacggcgcctcccgcttccccaacatggacgtgtgcgccaagagcggcaccgccgaggtggggggcggcaaggccccccacgcctggttcgacggcttcctccgcaaccccgacgccccctacgccttcgtggtgctggtggagaacggcggttccggtgcggacgcggcgggctccgtggcggccagggtgctggacgcggtggtcaacggatactaaaagcaggcccccggcgcgcggcaaagccgtgcgccgggggtgttcttatagctgctccagtacgctgcgcaggagccaggcgtgggagtcctcctcccccgccagctccagaaagagctcgtggaggcagggatcggcggtctccgccgccgcggtctggtaggcggccgccccccgctgctcctccatgaagtgctcccgcagggcggcggagaagggggcgggggatggattgggtacccggtctaccggccagtaccgcaccccggagatgagaaaataggcggtggaaagccgcttggcgtggcggcgctcgtcggcggcgatggtggccagcacccgcccgctgtttccctgggcccggcgggatagggcctgataggccctccaatccgccagttcccggtcaatgagccgctggagctgggcgccgtacaccgccgaggacgcccccaggcagggcacgtcgtgctcttctcccaccacgggccgggagggcgcctgttcgccggctggagcagtatgtaccacggcaggcagagccgctgcggggggctggacagccggaggggcggcggcgtcctcgcccagggtaaaggggcagtcgggccggtcctcgggcatcacccgccgccacacccgctcaaagacctcctggtcgcaggagcagggcaaatgatcttgttccatagacaaagcctcctgatgatttggattcaccttatcctatgcgaatagtgtggtttttgcgcccggcagggttgtattttcccccccgccgtgataaaataacatctcatgagaagaagcatagtacaaaggagagaccgcgtatgctggagataaagcatctcagctaccaggtggagggggagtccggcgaggagctgggtatcctcaacgacgtctccctcaccgtagctgaccatcagtttgtggtcatcaccggccccaacgggggcggcaagaccactttggcgaaggccatcatgggcctggtgcagcccaccgggggcaccatcgcctggaatggcaccgacatcaccggcctggacatcacccagcgggcccgcctgggggtgagctacggctttcagcagccgccccgcttcaagggcctgcgggtgcgggatctgctggccctggccgcgggcagcgagaagctgacccgggaggagggctgccagtatctgacccgggtgggcctgtgcgccgccgactatatcgaccgggaggtggacgcctccctgtccggcggcgaggtcaagcgcattgagatcgccacgattctggcccgcaagtcggggctgatgatctttgatgagccggaggcgggcatcgacctgtggtccttcgccaagctgaccgagaccttcaaggccatccaccagaagcgggaggccacgctgatcgtcatctcccaccaggagcgcatcatcgacctggccgacgagattgtgatgatccgcgacgggaaaatcgccaagcacgggcccaaggacgagattttcccccagatcctggccaacacctcggccgggtgcagctatatgtcggagggggcgaggtaagcatggatcaggctgagtggaaactgctgaaagagatcgcggagctggagaagaccccccagggggcctacaacatccgccgcaacggcgcgctggactcccggaacagcaccgccaacattgagatcaccaccaagaccgagccgggcaagtcgggcatcgacatccgcatcaagccgggcaccaggcacgagtcggtccacatcccggtcatcatcagccagaccgggctgagcgagatggtatacaacgacttcttcatcggcgaggactgcgatgtggacatcgtggccggctgcggcatccacaacaccggctgcgagaccagccagcacgacggcgtgcacaccttctacgtgggcaaaaactccaaggtccgctatgtggagcgccactacggcgagggccccggcaccggcaagcgcattatgaacccccagaccgtcgtgtatctggaggagggggccaccatcaatctggagagcacccagatccgcggcgtggactccaccaagcgggagacgaaaatcgtggtggggaaggacgccgaggccatcatcaccgagaagctgctcacccacggggagcagaccgccgagagcgatatggagatcattctggacggcgagggggccaacggccgggtggtgtcccgctcggtggcccaggaccagtcccagcaggtgttctaccccaaggtgacgggcaacgccaggtgcttcggccatgtgcagtgcgactccatcatcatgggcgacgccagaatttcctccatccccgccatcgtggccaaccatgtggacgcccagctcattcacgaggcggccatcggacgcatcgcgggcgaccagattctcaagctcatgaccctgggcctcaccgagcaggaggcggaggagaagattctcgatggattcctacagtaagcttctggagctggtgaataccagcggctgcttcgcccccgccaaccacatgtacgtcaccgagctgcggccggatcacagcgccgtgggcgtgctggaggtgcagccctccagcctcaaccccatgggcatcgtccacggcggggcgctggtcaccctggcggacaccgtgtgcggcacggcggccttcaccaccgggcacatgtgcgtcaccctggactgctccatgcagtatctggccccggcgtccggagcgcgcatcacctgcacggccacgcccaggaagctgggcaaaaccgtcctggtgtacgaggccgtgctcaccgacgacacgggccggacggtggccaccggggtttataccttttttgccaaggggccggcaaactgacccgcatcctcaacaggcgcgccgcagggcgcgcctgctttatttcagatgacctcccccgaggcatcccgggtgcccagcaggtcgtccagccgcagcagggcggcgagaaagacaaacagggaggcccacaggttggtgcacgccgaccgccgggccgccggcgtcccgccccgggcggtctcccgctccgtcttgagggccagacagaggaaaaagcccagcgctcccaccaccagggccgaggcgctcaggcggatgggaaacacccggggcagggcggccgccccctcggcatccccctggagggttctgcacagcccctcccgctgtatgcgcaccccccagtaggagagcagcaccgacagtacgatcaacagcagaaacagcagggattcatccaccgtcctgagctgctcccgcaggactgtctcttccatttttccacctccctgccctattttatggggatggggcaggttttgtgtgtttcctccgcctcgcctgaccttttaaaatagatttattctgatacttttaacaaggtcagttggagcgtacaatggggacagatgaaacaaggagggagcccctgtgcgcgaatcgaaaaaactccggctgctctgcctggccgccctgttcgccggagccattgcggtcaccaccgcctatctgctccatatccccatccccaccggcggctacatccacctgggagacgcgctgatctacctggcggcctgtctgctgcccgccccctacgccgtgggcgccgccatggtgggggccgggctggcggatctgctcaccgcgcccctgtgggtggtccccacgctgctcatcaaggccctggtggccctcctgtttaccagccggggaccgcggctcctctgcccccggaacggggcggcccttctgctggcctgcctgctctccccggcggcgtacggcctggccgcctgcctgctgctgggcggcgtcaacgccttctggccccagttcctgggcacgctggtacaggcggtgggcagcggggcggtctttactgtcttggcgctggccctggaccgggcaggcggtaaagccaggctcgctccccacagccagggctgacttttccacccgtttggtcccccgtgtggaaaacttccccttgcccaatgcccttgagcggtgctatcctattctcacacgaggagggattgttatgaagcgcgtgaaaattaccgttctgaaaaccaccctggaccgggagctggcagaggaatacggcgccgaggggctgacggcctgtcccatgctgcgggaagggcaggtcttttacgccgactacgccaagccggagggcttctgtgacgaggcgtggaaggcggtctaccagtacgccttcgccctggcccacggcgcgggggaggggctgttctactacggagactggattcgcaagcccggcgtggccatttgcagctgcaacgacggcctgcggcccgttatcttcaagctggaggccacggacgaggaatcccccctcagctacacccccgtgcagtaactggcgtgtcaaaaaccgccccccggcgcaggccggggggcggtttttcattttattagaatttggtgccgccgaactcgtggaaggtgaggttcttgttccgctcctccgtccagccgatggcccactgggaaccgaacagcaggagctggttgcccttgtagtcctccaccagcttcacgtcggtgcccaggatgagatcctcctccttgacgggctcgccgtcgtcggtctcgatccaccgcaggtattcgtagggcaggccctccatgtagagctccacgttgtactcgttcttgaggcggtactccagcacgtcgaactggagggtgcccaccacgcccacgatgacctcctccatgccggtgtagggggtcttaaagatctgaatagcaccctcctgggcgatctgctccattcccttcaaaaactgcttgcgcttcatggtatccagggagcgcacccgcttgaagtgctcgggtgcgaaggtggggatggggtcgaagcggaattttttgcccggggcgcacagggtgtcgccgatggagaagatgcccgggtcaaacacgccgatgatgtcgccggcgtaggcctcctcgatgatctcccgctcggccgccatgagctgctggggccgggacaggcggagcttcttgccgccctggacgtggtacacctccttatccgcgtcgaagcggccggagacgatgcgcataaaggcgatgcggtcccggtgggccttgttcatgttggcctggatcttgaacacgaaggcggagaagtcgtcgtccagggagtccaccaccagctcgcccgcccgccggggcaggggggcggtggtcatctggaggaagtgctccagaaagggctccacgccgaagttggtgagggcggagccgaaaaacaccggggagagcttgccgtggcgcacccggtccagatcaaacgcggcggccgcgccgtccagcagctcgatctcgtcggtgagctgctggtggagccgctcgccgatcagtccgtccaggttgggatcgcccagctccacctcggtggcggtggccgccttggctccgccgttggaggtgaagtggataatcttgcggctgccccggtcatatacgccctggaagtccttgccgcagccgatgggccagttcaccgggtaggtctcgatgcccagctccttctccagctcctccagcagctcgaaggagtcccgcgcctcccgatccatcttgttgataaaggtgaagatggggatgtcccgcatggcgcacaccttgaacagcttgcgggtctgggcctccacgcccttggccgcatcaatgaccatcaccgcgctgtccgcggccatgagggtgcggtaggtgtcctcggagaagtcctggtggccgggggtgtccaggatgttgatgcagtagccctcgtactggaactgcatgacggaggaggtgaccgagatgccgcgctgcttctcaatctccatccagtcggaggtggcggcccgggtgttctttttgcccttgacctgcccggcctgggcaatggccccgccgtagagcaggaacttttcggtcagggtggtcttgccggcgtccgggtggctgatgatggcaaaggtacgccggcgattgatttctttctcgtattgtgacaaggtaatgtcctccttgatagagttggtgcatgggtgccgggcggatgtgggcatccgcccctacggctggaacaggcccgcatttggacgttgtagggggcgatgcctacatcgccccgccttacggcggagtgaggcggcggatcgcatcgggaagatccccaaaggtagccaccgagggcacagggcggtcaatgcgcccgaagccgtaggcggcatggaggaaggggacgcccgccttggaggcggcgtcatagtccccctgggtgtccccgatgtagaggggccgcctcaggccgttccgctccgccaccagggcgatgttgtccgccttgggcagccccgtgcggccggggttttcgtagtccgtaaaatagcgccccagtccgtgggcctggaaaaaggcctcaatatacccgtcctggcagttgctgacgagaaagaggggacagcgggcggagagcgccgccagggtctgctccaccccggggtagaggacgcccccgtgggcggccacataggcgttctcctccaccagtacctcctccagaatgggcttcatccgctcctggtccagctccggcaccaggcggtggaggatgtcgggcagcagcatccccatacacggcagcagccgcgcccgggtcacggtgccggcatactccggcgcaagccgctccagggcccggttccaggagatgcagatggcgtccaccgagtcccacagggtcccgtccagatcaaacagaagtccgtcaaacacgtccatacccccggttccgtctcacaaaaacgaccacatccgaagggatgcagccgataccaataccttgatactatatcatacccaagccgcccttttcaagcctccctgtcccatattttgcacaaaaagccggggccgctgggcggccccggcttgggagctgggttacagggtgagggcgcggtggagaatgacggccatctccgcccggttcagggttccggtggggttgagcttgccctgctcgttgccctggatcacgcctgcctgggccatggcggccatggccgtgcgggcgtagtccgccacggaggccccatccgggaagcggctcaggtagctgtcataggcgttgggcacagaccggttgacggcctgcatggcccgcaggaggaacaccatggcgtcctgccgggtgacagggtcgttggggcggaagctcccgtccgcctcggcggtggcgatgcccagagccttggcatgggccagggcctcggcgtagtagctgccggcggtcacgtcagtaaagttgcctgcggcggcggtgctgctgaagccaaaggtgcggtagagcatcaggatatagtcgccgcgggtgagggtggaggcggggctgaaggtggtgccgtcgcccgtaccggtggtaatgccgtaggcggccaggaattccacggaggctcccgcccaactgttatagctgcccatgtcgctgaagcgggaggaggcggagggcgtgaccatcacctgaacggtgccggtgtactcgatgccgtcggcatcggtacccacataggggatggtcacaatgccgctgtagcccgctttgggcaggaaggtgacctcgcccagcaggtagacgccgcccacggagtagtccacggaggaaaccacctcgccgcggtactgggtgggagtgtggaagttgtagtagagctgcccgccggtggtgtcgggggcggggaaccggacggaggtcagggccttgccgccccgggccgcgcaggcggcggtaaagtcggcggcgttgaagtccacggccaggccggtggaggtgtaggtgatgatagtgggctcactcagcgtcacataggtcagcttgacctcgccgtagaaggacttgccgttggtggcctccccctcaaaggggatgcgcacggagctgccggtgccgctgccggggacaaaggaaacctggtccagccggggagaggaggcgcggtaataacggccggagcccacctcagactcgccggactcgccgtgctggtagtacagatagccgccgcggccggagtcgtagtcaaagatcacatagttcagattggcgccggtctccttcacgcaggcctcgttgaacgcgtccgtctggaagttgacggtggaaccgttgccggcctggagctccacggtaatgtcggcgcccccggcatcgcccacccgaatgaccagctcgccggagaacttgtcgccgtcgtccgccctgccctcaaaggggatggtgaccgccccttcaaaattgcgcttgggtacgaaggtcagattgtcgatctcgtcgtggcggatttcctcgtcctcgtcaatctcctcctgatcccgcttgtcatagtcccggtagagggtgccctcccgggaggagggcagctcggtgaaccagacccgtcccacctcggtaccgctggtctcgtcgtagacgaactcgtcgaagtcgtcatagtcgaagtccaccgtgtcgttgacgtccacatcgtacgtcacgtcgcccctggcggcgctgctgctccggccgccgcccacctcgatgaccaggtcgccgtagaacttatcccgggcgtccgatcggccctcgaaggacagggtaaccgtcccctcataattccgcttgggcacaaaggtcaggtcgtcgatctcgtcccggtcgaactcctcttcctcctctacttcgcgttcactggagtagccatagtcgtagtagagggtgcccttgctggaggagggcaggtcggtgaagaagatgtaatcgacctcggtgccgtccgactcgtcgtaggcatagtcgtcaaaatcgtccacgtccagatccacggcgtcgttgacatccacctcataggtcacttcgccgtcagaggatgaacgccctgtgccattgacctcaatataaagtgtaccagaaaaatcctcaccctggtcggactcaccgctaaaaccgatcgttacgaaaccatcgtagtcctcatctggcacaaaggcgagatcatctaggtctctgcgggtaaagctctctcgcttttcgacctcatattcgtctcggccgtcatagtcaaaatatagcacacccttactggacgagggtaagcttgtaaaccagagcccatccacctcggtaccctgtgacgtttcgtcatacacaaattatcgaagtcctccttttccaagtagaggacctcatccgcatccacctcgtattctacatttcggctcgccgccgtggccccgggtaccaagctcgtcaaaagggccagactcatacccgcggacagcagccgggcaagccctctatgggtttgcttcatgttcattctctccttccaatgcaggtttttccttggttatatattccattatccaacattacagacgaaatgtccagagcaaggttcccggtattcattaaaaatatcttaaagtctgatcagaacagccgggagggagcccgcaggctccactcccggctgccgccgtgtatgaaattgcgcttatgtctgccttactcggcggggcggaccagcacctcgtcggtctcacccagcaggatggacttctcgctggggcgcagttcgccggtgttctcgtcgcggccctggaggacaaagcgggcgtcaggatcgccgatggactgggcggcctcgttggagccctgccagatgggatcgctgctgggcttgcggtaacggttgaagatgacgcccagctcggtgtcgccgctctccatccagtcggtcatcatgttccagtcgccggagctgtcgccgaagaccatcagggggccggcgttgtcatactggggcgcgatgaagttggtgataatggtgctcttgccctcaccctgggtctgggcgtacttgccctcgccgccccagtcgtagttatactcgttgatgtagcggccgtcctcgcccagcttgttgcgcatggcgtagacgtggtcctcgggcaggttgtagcccatggtctcattggcggccagcacggtgtcgatgggggaggcagagacgatatacacgtcgatgccgttggcctggagggtggcatacaggtccttcagctcgtcggtgaaggtcaggccggtgataaagtcaatcgagacaatgccggtcttgccgggcagctccacgggagaggtccaggtttcctcggcatagcggccgtagtctgcccaatactggtgggaggcggcagccagcttctgcacctcgtcgggggtcatgccggtgaacagatagccaacccaggggtaagagacggcgtgatcaaagtagtcgcccaggttgccgtacatgaagcgcagcttggcggcgaagtcctggtactggttggacgcgtggatgtagttgaggtccttgtccccctcaaagccctcgtagttggcatagatccactcgtaatcgctggtgatgtcggccaccagggtggcgggggtgatgttcttgccgtccaggctggtgcccatggacttgttcaggtcgggaatgccggtctccagaacggcctccatgtcggcggggtcgatcttgaattgcaggttctcaatctggtagatgagcagggcctcctgaatgtcgaagatcacggaggtgttgtcaaagtcaaagaccacgtacttgccctggttggcgttctcgtcaatcacagcctggatgcgggcgcgggtagcgggggcccagttgccggtgatgagctgggtggtgtcgggcttgtagtgggagccggtgtcgatggccgcggtgtcggtggccttatcccaggtcaggcccacgtccagcgcgctggcgaaatcgcgcagcttgtaatagttgttgccgttgtcaatattgtatccctcgacagcggccgccttgccgtccaccgtgaccttggtggaggcgggcaccagagaactggctgccagcgccgcgggaatgctcaggcccatggtgagggcgagccccagagcgatcagtttggatggcttatgggatttcatttcatgtttcctcctctttttctttccttgcgaccaggagtcctccggcgcggagtctccagtggtcagagctccgaccccgcaaggtgttttgcatgataccatgagcatcttccaattgcaaccatgctcacattattctgccttttgcccgattttagccactctattttgtttaaattgtatatatttatcctcttatttgtcattatttttagtgagcatgctctacaaatgcggtaaactccaattatttacctcccttttacagcaccatggtggcagttgggctctgatccggcctacactggacgggaaccgtacctcccgcccccgcagaaaggagaacccccatgcttccctgtcagagccaatgtccctcctaccacagcggctgccacaagagctgcgcctgctggaaggcctttcaggagcgccagcgcctccagcgccaggcaaaaaagaagtatctgaagttctacggcgcgctgtgcgcccaatccctccgccagctcactgccggacagtcccgccgtccggcgtggtgactgcatgcccgcgctctcctgtcacggcggcggcaaaggcccctctcagccggacgacggggaggggccttctctgccttgctttacttgcggcgcttgccggtgtagatgcacatgagcatacagaacacggcgccccaagcccagaatctatgctgtttcattgccaggctcctttccctgggccccgcgcccgccgggcgcgggcagatagggccgcatgctggcggcgctgatggccatggtagaggcattgtgcagcagggccgtggtggtcggcggcagtatgccgaaaatccccagcgccagcaggctggtgttgatggtcaaaatcgacctgtagttgcggttaatgcgctccagcatccgctgggagaggcggcgcagggcggccagctcccgcagatcggaggagaggagggtaatatccgccacctcccgggccaggtcggaggcatccctcatggccacggatacatccgcggcggccagggcgggggagtcgttgaccccgtcgcccaccatgatgagcctgctgccgccctccttgtagccctcgatcagggaggccttgtcggctgggagcacctgggcgcggaacgtgtcgatgcccagccgctcacacaccgcccgggcggcggtctcctggtcgccggtgagcatgatcacccggcgcacccccagcgcccgcagggcggcgatggcctcagcggcctcggggcggggcggatcgctgatcaacagcacaccggccagcctgccgccgatggccagatagagcaccgaacggccgcgggcggccgcggcgatccgcctagcctgttcgtcggtacaggcaacgccctcgtcctcgaagatgaagtggcggctgccgatgagggcccgctccccctccagggtggtggccacgccgtgggccaccacatactccacctcggcgtggcgctcctcgtggttgaggccccgctcctcggcggcgcgggtgacggcccgggccatgctgtgggggaagtgctcctcgatgcaggccgcgcaccgcagcagctcgtcctccccccggccggtgaagtccagaacctcctccacccgggggcaggcggcggtgagggtgccggttttgtcgaatacgatggtatccgcctcggcaaaggcctccaggtatttgccgcccttgaccataatacggcgggcggaggcctcccgcatggcggagatgatggagatgggggtggacagcttgatggcgcaggagtagtccaccatcagtacagacagggcccgggtcacattccgggtcagcaggcccaccgccagggccccggcaaggctgaagggcacaatggcgtcggccagccgctcggcccggctctgggctccggccttcagcgcctcggaattctcaatgaggcccacgatctgctgaatccggctctcgccggccagggccgcggtctggatgaccagactgccctcctccagcacggtgccggcgtagacggtggagccctggcgcttgtggacggggaggggctcgccggtcatggacgcctcattcaccatggcgtcgccgtctgtgacagtgccgtccaccgggatcagggcgccggagcgcacccggatacgctcccccagagccaggcggcccatggggatggattcctcggagccgtcctccgccacccgccacacggtgtccacgtggatggccaagctctgggtcagggtggtctgggtgcgcttgcgggtgtagtcctccagtagggcggacaggcccagcaggaacatgaccgagccggcggtggaccactcccgccgggcgatggctccggcgatggaggccgcatccagcacggccacgtccagccgccccccgcccaggcttctcaggccctcccgccagtagcccgccgcgttccacagagtcacggcgcagcggacagggaagggaagaaaccactttttcaggaaatggcgggcggccatggaaaggagccggcccagaaactggctgtccacctggcggagctggtcatcgtcggcggcggtccccaccggcagggcgtcccgccggagcccccggagtactgccagggcctccgcccggccctccccctcgtagcacaccagcacgctgccattgagcgcacaggtgacggcctcccgcacgcccggacggcccaggagcagggcggcaatgccgtagccctgctcctgggtaaacgcatccgggccgaagcgcacccgaaggcggccgggctcgtcgtatgcgatgcgatatctcatggctgcgttacgcctcttcggcggtctcctgggccgccttctgcttggcctccgcacacagatcctgagcgtcctccttcatgttctggagggtcaccctggcgtcctgctggagcttcatgcccttggccatgccggccacgcagagctcacgggtcttgggggacttggcaaccttggctcccaccagggcggcggccacgccgccggcaaagcagaggaccttcggattctgataccacttcatgattggaaaacttcctttctctgtctgtctggaacatggatgggctcaaaacagtggcggggcagctcggagactgccgcgcaggcggccttccacgcctcctcataggacagctccatccggttttgcagcgtctcggccagtttgtccgtctggctggccagcacccgggcccaccggcagccgtcgtcggtcaggtgtaccttgccgtaccgctccttggtcaccaggcgcttgtctgtcagaatggacatcatgctggtgacggaggcgcgggacacgtccagggtctgggcgatatccttggaggacacctccagccgggcctgcgagaggtggtagatggtcaaaagatagcgtacgttggtattggtcagctccatgtatgactccttaactaaggggcgccagccgcgccccggcgtgtcggcggttgcttctcagggtggcacagcccggacgaggcgcagtggccgcaccctccgccgcaggagcccccgcaggagcaggagctcttgccatggcggcggttgtaaatgccctttcccacaatggccgcaaacacggccaaaatgatcaggccaatgataattgttggtgcattcataggcgctccttacttggccgcggcggcgacggcggaaatggaaagggtgttctcgtcgtacttgtttctgcggacaaggaggtagaccaagccaacgagggcggcggcggcggcgatggtgccgatgccgaaggagacctcgccggtgataagcccgccgagctggtagacgatgagggagaccacataggcaaagccgcacatatagccgatggcgcccagggtccacctggcgttgttcatttcccgcttgatggcgcccatagccgcaaagcagggggcgcacagcaggttaaagatcataaagctgtaagcgctcagggcggtgaagtgggtgcccacggcggccagcaggccggggtcctcctccgtcagatcggcgcccagaccgaagagcacgccgaaggtggacaccacgttctccttggcgatgaggccggtaacggtggccacggtggcctgccaggtgccgaagcccaggggccggaaaatgaagcacaccgcgccgccgatggccgccagcagggaggtgttgttgtcctccaccataccgaagcccgcctcggtaaagccgaagccctggaggaaccagaggatgatggaggaggccaggatgatggtgccggcccgcttgatgaaggaccagccgcgctcccaagtggcccgcaggacgttgcccacagagggcacgtggtaggcgggcagctccataacgaagggggcggggtcgcctgcaaacgccttggtctttttcaggatgatgccggaaaggatgatggccgccacgccgatgaagtaggcggacaccgccaccaggccgctgccgccgaacagggcgccggcgaacaggccgatgatgggcatcttggccccgcagggcacgaagcaggtggtcatgaccgtcatccggcggtcgcgctcgttctcaatggtacgggaggccatgacgccgggcacgccgcagccggagccgatgagcatggggataaagctcttgccgctcaggccgaacttgcggaagatacggtccatgatgaacgccacgcgggccatgtagcccacatcctccaggatggacagcatcaggaacagcaccagcatctggggcacgaagcccagcaccgcgcccacgccggcaatgatgccctccacaatcagcccctgcagccagggggcggtgccgatgccctccagccagccgcttaccgccggcggcacaatctcgccgaacagcacgtcgttggtccaaccggtcacccagtcgcccaccgtgccgatggccacatagtacaccgcaaacatgaccaccgcgaaaatcggcagggccagaatccggttggtcacaatccggtcaatcttgtcagaggtggtcaggctgtgggccgccgccttcttcttcacggccttgttcacaaccccgttgatgtacgcgtaccgctggttggtgatgatgctctccgcgtcgtcgtccagctccttctcgcagtcggcgatgtgggcctccaggtgggccttcagctcacccgtcagattcaactgggccatcaccttgtcgtcccgctcaaacaccttgatggcgtaccaacgcaggtagcggtcgtccaccagccccgcgatggactcctcgatgtgggcgatggcgtgctccacgctgcccgtgaacacgtggggcagctcacccgcccggtgggacttggccagcgccacggccttctccgccgcggccataccgccctcgcccttcagcgcgctcatgctcaccacctcgcaccccagggcctcccccagcctgccgaggtcgatcgtgtccccgctcttccgcaccaggtcgatcatgttgaccgcaaccaccaccggaatccccagctcgatgagctgcgtcgtcaggtacaggttgcgctcgatgttcgtgccgtccacgatgttcagaatcgcgtccggcttctcgcccaccaggtagctccgcgccaccacttcctccagcgtgtacggagacagcgagtagatgccgggcagatcctgaatgaccacctccttgtggcccttcagcttgccctcttttttctccaccgtcacgccgggccagttgcccacgtactggtttgaaccggtcagggcgttgaacagcgtcgtcttgccgcagttcgggttccccgccagcgcgatcttaagctccataatctctcagtcccttccttttccgcgagtttgatataactaattcacagatgcagtaccgctccgctgtgccgcctttggcggcgcggccgtatccggggaagcgctccccctaggcgatttcgatcatctccgcatcggccttgcgcacgctcagctcatagccgcgcacgttcagctccatggggtcgcccagaggggcgaccttgcgcacgtgcagcgccacgcccttggtgatccccatgtccatgatccggcgcttgaccgccccctcaccgtggagcttgaccaccgtgacagtgtctcctacctttgcatcccgcagtgtcttcatgttctgtctcctctcctcagatcataacccggttggccatagtcctgtccagagcaatgcggctgtccttgacctgcacaatcaagttgccgcccagctcgctgaccaccgtaaccgttccgtccaccacaaatccaagctcggccaggtgctggcggatctcatccttcccggtaatcttccgaatggtcaccgtctcgccctgctttgccagcgtcagaggcatcatcgtggcttctctcccttacaggttaactcttgctaaccaattatcttttatcaggcggttagtgtttactaaccgcccagaacaaattgagtttacacccgctaactcaatttgtcaatagtcttctgcatatttttccctctgcacaaaattgccccggtgcgcagagccgcaccggggcaatttttcggttctatcccgcgaaaaagcgcagcaccaccgccgccagcagcacaaccaccgcgccagtggccgccagatccacggtcagcgccagcgtgcgccgccgccggaccggccggggccggccgggcacctcctcccgcggggcatactcctccgggtgggcggcctgccggtaggcggtgaaatccaccaccttcccgcccgcaggcatcaccgggcggcggggccgggggacaaaggcatagcagaccgtctcctgcccgccgctggccctgcggcccgcggcttctccgcagacagtgagtcgtttggcatccagactgtaatagatggtctccatgtcgttccctcctgcatcggttttccagttgacagaccgattttactccatgttctgtcccatagaccggaccgggccggcccgggcccgcgctctgtctgtatagacgggctggggcgaaaaaattcaatgggttagatagaactttcgttcgatttgagtatacaacatttgttcgatttttgcaagccccatttatgtacggcagcacaaaaaacgggacagcccgccagggccgtcccgttttggggaggttgtgctatacagataccgatttctgcgcaagatataactgtgcgtattctccgtccttggccataagctcctcatgggtcccctcctcctgaatgccgttgccgtcaatgacgagaatacggctggcagagcggatggtggacaggcggtgggcgatgatgagggtggtgcggccctttgccagctcgtcaaaggcggactggatgcgggcctcggtgaccgagtccagggcggaggtggcctcatccagaataaggacgggcggatttttcaggaaaatgcgggcaatggacacccgctgcttctggccgccggagagcatggcgccccgctcgcccacctgggtctggaagccgtcgggcatgtccaggatgtcgtcgtagatctccgcccgcttggcggcctccacgatctcggcctcggtggcgtcaggccggccgtagcggatgttgtcgtagatggtgccggcaaagagaaagacatcctgctggacgatcccgatattggcccgcagggagtgctgggtgagggtgcgcacgtcctttccgtccaccagcacccggccctcggtgacatcgtagaaccgggggatgagctggcacagggtggacttgccgccgccggaggggcccaccaccgccacagtctcgccgggccggacgtggagggtgacgtgctccagcaccggcagatcggagggctcataccggaaggtcacgtcctccacccggatgtcccccttcacgtcggtgagctcctgggcgtccggctcgtcctggatgtcgggctccacccgcatcagggccacaaaccgcttgaagcccgccatgccctgcataaactgctccacgaaggcggagagcttgcggatgggggtgatgaaggtggagatgtagaggaagaacgtggtcaggtcgatgagatccatccgccccagcatgagcaggaatccgccgaaggcgatgactaccacggacaggatgcccatgaagaactccatccccgactgatagaaggccatggcccggtagtagccccgcttggccccccggaactggtcgttggcctggtcgaatttggcgctctccgccgcctcgttggcgaaggccttggcggtacgcatgccggagatggaggactcaacctccccgttaatgcccgccagtttggccttcacctcagtggaggcccgcatcatccgcttgcggcacagggtggtgaacaggatgaacagggggattaccgcaaatacgatcagggccagctcccaccggatggtgagcatgacgcagaaggcccccaggatggtgatggaggagatgaacagatcctccgggccgtggtgggccagctcggtgatctcaaacaggtcgccggtgacccggctcatgagctggccggtgcggtttttgtcatagaaggaaaaggacagatcctgcatgtgggagaacagatcccgccgtatgtcggcctccatccgtacccccagcagatgcccccagtaggtgatgatatagtaaaagcaccccttgagcacgtaagccccggccagcaccgccattaccacgaaaaacgccgtgaacatctgtccgggcagcagcgtctgcatggaaaagcgggagacgatggggaaggccaggtccaccaggcagatgcacagggcacacaccatatccagtgcaaacagcttccagtggggccggtaataagaggcgaatatcctcagatatccgtccgttttccacctcttttgcttcatttgacgactcctctctgcaggtcgattgtcatatccggtcgagccgtgcgccgcgccgccggcatggccctcttattttaatgatatcccgccccaatgtcaactgagcttcctcctccgccttgcaaagaagggctaggccgcttataatagaaccaccagaaataagggggaagaacgatgggtacaccacacaatgaggccgcccagggggcgtttgcaaagaccgtactgatgcccggagacccactgcgggccaaattcatcgcggagcattttctcgacggcgccaaactggtcaacaatgtccggggcgtacagggctataccggtacctaccgggacacgcctgtgtccgtcatggcctcaggcatgggcatgccctccatgggcatctactcttacgagctgtttcacacctacgacgtggacaacatcatccgcgtgggcagcgtgggctccatctctccccggctgaagctgcgggatgtggtgctcggccaggccgcctgcaccgactccaactaccccaggcagtacgggctggacggcaccttctctcccatcgcggactttacgctgctggagagcgccgtgtcggcggcccaccgcctgggcgtggagaccgccgtgggcaacctgctcagctccgatgtcttttaccgccggacggaggatactctggcctggggccggctgggcgtgctggccgtagagatggagagcgcggccctttactgcaacgcggcggaggccggcaagcgggctctggccgtctgcaccgtttcggacaacctgctgaccggcgaggccctctccaccaccgagcgccagacctccttcacccagatgatcaccctcgccctggaggtggccgtggacatggccgcccggcgcgcgtgaacgggcgtggaaagagccgcccatcggggcggctctttccacgcgaaacaataagggaggacataacccctgtgggtcatgtcccccgctaatctggtggacgatacaggacttgaacctgtgacctcccgcacgtcaaacaccaaaaatgattttttctaatcttttttgacagtgtataggtatttttcttccaaataacttgctttgcggtatgtttgaaacgcaaaccttccggctattccgaccccgtctgtggcttgttgtgtggtcaaaacaattttgaaatagtttgagtacctaacaatttttcaccaaaaaacatttgaaatctaaaaagaaaagccatataatgtttaagtaaaatcgtttccatcaagaatcgtgtagcagaaatgcgtaagtccggatccgggcttgcgcatttatttttttgaaagaaaggtgatcaaacatggatacagcaaatcagtttttaggaactgaaaagatcgggagcctgatgcggaaatacgccattccctgtattatttccctgctggtaggcgccctttacaacattgtggatcagatttttatcgccaacgccagctatctcggctcttacggcaacgccgccaacaccgttgtcttccccctgaccgtagtggcactgtccattgctgttctggtaggagacggctgctgcgcctttgtcagcatcagtctcggtagaagcgaggtgagtaaagcgaaacacagcgtcggcaatgcggtcattctcgctgtggccagcagttttatgctgaccgctgtttatctgttttttgctgacaccatcatcgccatgttcggcggcacggtcaatgaggagacctttcactactcccaggagtatttcttctgcatcaccctgggcattcccttctatatgttcgggcaggccatgaaccccatcatccgggcggacgggaatcccaagtttgccatgatctccaccctcctgggcgcagtcatcaatatcattctggaccctctctttatcttcgacttccggtggggtatgatgggcgcggcggtggccacggtccttggtcaaatcgcaaccgctgccctgtccatctggtacctctgcaacatgcgaatcatccggcccgggcacggcgattttagactggctcgaaagatctgcaaacggatgctgctcctgggcattaccagcttcctctcgcaaatcagcctggtggcagccatggccgccatcaacaatatgctgcgcaagtacggcgccctggaccccgttttcgggctggaagaatacgcccagatccctatggccgtggtgggcattgtgatgaagttcttccagatcgtcatctccatcgtcgttggtatggccgctggctgtatccccatcgtgggctacaacatgggtgcggggaaggcccaacgggtcaaagcactgttcaccaggctgctgattgcggaagcggcagtaggcgccgtggcgctgctctttgcggaaggattcccgcagcaactcatcaacatcttcggcgcggccaatgagagtagctactacacggagttcgccatcaaggctttccggacctacctttgcatgatgattatggcctgtgtgaacaaggcttgctttatctttttgcaggctgtgggcaaggcgctggccgccaccatgctctccatgttccgagaagtggtgttcggcgtggggtttgccctgcttctgccggtgtttttcggactggacggcgttttgtattccatgccggtgtccgatgtcctgactttcctcattgcagtgtttatcatctgtaaaacatatggaaaactgaacacagaaggaactgaactgatatgaaaaaatcgtattgttgccatcagccgggagtttggcagtgacggacacaccattgggaaaaaggtcgtggaaaagctcggtatctgttgctatgacgcggagttgatccattaagttggctagtaaaagtggacttacgcaaagctgtatcaagcaaggtggggagtgtacccccaacgattctcgtcatttgcctcttcaaccatttacatggactcaccaacaaagatatcaacagctttttatgttttttatgaaatgaatttatcacactgttatcaaagatgtaaccggcatcccacctaataaaataatctggtctgtaaattcacacaaaccaagcagatccgtttggtcagatcagttgattttaaaatatattcccttttcaagataagtgttgctgacgaatgcaactaaaaattgggtactaaagatttttgtatttgagtagtctcggcagcgttgataagtagtttgccccaaatggcagggagcggtcttgcagggaggatgttctatatagcaaattccgagtccgcatttatcaatcgctgtttatgaatcgtaggctgttacaaggaaagtgaggcagggaaactgtccctgcctcactttctgccatctgtatcatcttcatgaactgatggcggtggattatgtgctttttgaatggtacggtttttggcttagttgtattctctgattgcctctgtaatggctgatgctgttttacgtagttcggcgacatagttgcccgtgcaatcctgaatggtttgcgcgagccctaccacgccaactgcggcgatcacatggtttgatggatcgaagaccggacatgcgacacttccgaaaccgggaaagcgatcgtcgatatctgtggcataaccgctgcgtcgcacctcggccagtatcacccggcattgattctggtcggtgacagaacgtggtgagtagcgtttataggtgtagcggttcagtaaaacgtctagctgcttttcaggcagaaaggctaaaattgcctgacccatggcggtagcgtaggccggagcattcatgcctactcgtgccgttacctgaatgtcatagggagattcctccttacaaatagtgacaatccgttcctgattgaggcaggagaggtgtaccgccagcttgcaccgcagggtcagattctgcagggcgggtcgagctgccgtcacgatatcctgctgtgccgccaccaagtttccgtagtagaggaacttcatccccaaccgataacgcgcttccggaagcttttggacatatccgttcttctccaatgtgtacagactgcgaaatacactggctttgtccattcctgacaaatgagttagttcggccaaggagagactgctggcatgactcagcaggtccagaagacacagagcgttgttgagggaactgagcaggtagcggtctttttccatggtggcgctcctttcgtttctctataatcaataatattatagcgctttctgggcaaaacgcaagaaggaatacagccaattgctcaaaaaagtagaacttattttgcgtatatttacaaagagaatggtgtttgatacaatttaattacgaaatgagccgtttcgcataaaacaataaaaggagagaagtgttatgggagaaactttggcaggtaaaaagccccgtaactacgccgtggatttctggcggttttttgccacactggctgtgtgttgggggcacatgggaagtgtcgggtttcggtttgttggcggagtcttttatcctgagagtacgttgctgaccagcggtccggtattgggcgtatttctggtatttaccggctattttctaatgaaatcctatgagggcaaaaaactcaaagggctgaacgagggcaagacgcccagccagctggcgcttacctacctgaagagccgctacatcggcctgtggccggcgctgtttatgggcactctgttcggtttcattatgagcttcatcggagcttataccggcctgtggcacggcaagctgttcatggtgggcgaggagttcaatggggtcaaggatatttttgccgcgttgaataccaccgcgctgcagtggtttggtctcgactccaccggcattctgtctgacaccggctgggccttccagtggaattcccccctgtggtacatctcggccatctttgtgggtggctacttcctgtactatctgctgtgcaagaatgaggatctgacccgaggcctgatcgtgcccattattgtaatcgtctgcccctgcgtttgggcgttgaatggctcactgagcatgaatgaccgcagcgtgctgttcctggggatctttgataatgcgctggctttcggtacctggggtactgcgcttggtattttcctctatcggccctatgaaagcctccggaaaatggtaattggcactaaaggcaagaagtggctgactgttctccatgtggtgctggccgcctggctgatctacatctgcattgctggcatcgacgggctgtatatcgcccagaccgccgacggcggccgggtcaattccgagatgtatgtggacctggtggttgcggtgaccatggccttcgctgtggccaatcaggattacctcaccagcaaggtgttcaataaacgcatttttggaaaactgggtgaattttccctgtactttttcattgttcacatccactgtattaatattgtctgtggcctggtaggtgcggagaatgtgaccacctccggtcagtactacctgtgcctgctggctgttatcgctctgtccgcagtgctgggtgtgatcatgcagttgatttgtaaaaaaggtattacgcctctgctgcacaagctggatgacagcatccagacctgcattaagcgcgggcaggaaaaggccgcggtgtaaaaccgcaccggtatttcaaaccctttgcttcccacgctcccaaaggggcgggacggccccgccgtcccgcccctttggcattctgccacggcataaataaaggagtcagtatcgtgaaaatcattacagcacaagaagccgccggcctgatcgccgatggctccacggtggctattggaggtttcggcgcctatggctgtcccgatcagcttttggacgctgtggtccagcgccaccgcacctgcgggcatcccgccgccctcactgtctttaccggcatcggcaccggaaacaacaccgatgacaatgtgggcctcaaccgcctgtgcgatgacggtctgatggagacccttattgcggcccacctggccaactgtcccaaaatcggacgtatggtgggagagaaccgcctggccgcctatgtgctccctttgggtgtggtggcacatctgctgcgggccattgccggtaagcaacccggcgtgctcacccatgtgggactgggcacctttgccgacgctacccaggacgcctgccgggccaatgacagggccagggctcagggccgcactgtggtggagcggatagacgtcggtggaaagcaacagctcttttatcccgcttttccggtagacgcctgcctgatccgggccacctatgccgatgaggatgggtgcctttcgtttgaccacgaggccctcaccggactggagctggagatggcgctagccgtccacaacagcggcggcaaggtgtttgcccaggtggaagatgtggtggctcggggcagcctccaccccaagaaggtgcgcatccaccacactttggtggactatgtcatcaaggccagcccagaatttcacactcagagctatgctacgccccgttaccgtccggagctgtccggtgaaatccgcatccccaccgccgccatcgaaccgctgcctctggacatccgcaaggtgattgcccggcggggagccatggagctgcgggacggtatggtgatcaatctagggatcgggattccctccggtgtgggcgcggtggcaaacgaagagggcatcgcccacaccaccctgtccctggaatccggccccattggcggcgtgccggtggcaggagtaggatttgccgctgcggtcaatcctcagagcattatgtctctcagcgagacctttgacttttacgacggcggcggtttaaacatgacctgtctgggcgcggctgagattgaccgtaacggaaatgtgaatgtatccagcttcaaccggcgctgtactggcccgggcgggttcattaacatttcccaaagcacgcccaaagtgtattttatgtgtgcatttaccgccggaaagacggaaattcaggtgggtaacgggaaactcagcatccgaaaggatggggcaggcgtaaaatttgtggaaaaggtccagcaggtgaccttttccgccgactacgcccggcagactggacaggaggttctctatattacggaacgggccgtgtttcgcctgaccgacggaggcatccagctggtggaactggcgcccggcgccgacctgcaacgggatgttctggatcagatgggcttccggccattgattgcgcctgaactgcgcaccatggattcccgcctgttccaagagagacccatggggatcaaatttgaaaacagcaaggaggaactgtcatgaaggaatgtaatcaggtttatgacctgcgctccgcgctggagcgtctgcgttccataccaggacagctggtagagaccgacgtacaggtggacccggcggcagagctggccggggtctaccgccatgtgggggcaggcggcactgtcatgcggcctacccgctcgggcccggccatgctgtttaaccagatcaagggccacccgggcgcccgggtggccatcggcctgctggccgaccgtaggcgagtagcggccctgttggatagccgcccggaggagctgggcaagttactgcgggacagtgtcaaccacccggtggagccggtactcaattctgggggcgcaccgctttgccagcaggtagtccaccgggcagaggatcctgactttgatctgcgcaggttggttcctgcccctaccaacaccccggatgacgcggggccctacatcacgctgggtatgtgttacgccagccatccagacaccggcgtttccgacgtgaccatccaccggctgtgcctccaaggccgggacgagctgtccatcttttttactcccggtgcccggcatatcggcgccatggccgagcgggcggagcagttgggacagcgtcttcccatttccatcagcatcggcgtggatccagccattgagattgcctcctgcttcgagccccccacgacacctctgggcttcaacgagctgtctattgccggtgccctccgggggcaggcggtggaactggccccctgccttaccgtaaaggagaactgcattgcgaacgccgagtatgttatcgagggagaggtaatccccggcgtccgggtccaggaggatcagaacagccacaccggctacgccatgcctgaatttcccggctacaccggcccggccagcgaccagtgctggctcatcaaggtgaaggcggtgacccaccggcaggatcccatcatgcaaacctgtattggccccagcgaggagcatgtgtccatggcaggtatccccaccgaagccagtatcctggatatggtggacaaagccatgcctgggcggctgcagaatgtctactgcgccagtgctggcggcggcaaatttatggccgtgctgcaattcaagaagtcggtgccctctgacgagggacggcagcgtcaggcggcgttgctggccttctccgccttctccgagctcaaacacatcttcttggtggacgaggacgtggacccctttgacatgagcgacgtactgtgggccatgaacacccggtttcaaggggatgccgatatccttaccatcccgggtgtgcgctgtcatcctctggatccttccaacgatcccggttgctctccttccattcgggaccacggcattgcctgcaagactgtgtttgactgtaccgccccctttgatcagaaggagcggttccaccgagcccgtttcctggatgtggacccggcccactgggtgccagagctcttcccggaggtgtgatcatggcgaatagacggctgattgtaggtgtgagcggcgcctctggcgcaccggtcacgatagaactgcttcagcaactccagaccgagaaggacctggaagtgcatctgatctgttccaaatggggtctggctactctggagcacgaggcgggtgtcacccgccaggatttagaggggctgtgcacccgggcctatgatgaggaggatcggggcgcagccccggccagcggtagcttttcagcggtgggcatggcggtggtaccctgcagcatgaagaccctggccggcatcgtcagcggctactcggactctctgctcctccgggctgccgacgttacgctgaaggagcgccggcctctggtcttgatgccccgggagtgtccgctgagcaccctgcacctgcggaacctgaccgccgtcagtgaactgggggcggttgtggtgccgccggtgccagcgtggtatgaccacccccgtaccatggaagatgtaaaccgccagatcgccgcccggatcgtccggatgctgccgctgggtcgccagctgccttgggagtggaggggcctgtcatgacctttgcctgccgggttttagatcggcagatccgggctgagctctctttgctggacgacggcctttctgtgctcctcgccgggggagataaaagccacattggcgcggtttccgtggcagagcctgatggccggacgcagacggtggattttcccggtcatcgggagcgggaggtggctaagcagtgggcggctgtgcttgcccagatctgcggctgccggacagcggtggtctgcggtattcactatgatgggcttgcccgtgagggccttctctgtgtgctgaaggcacttgacgggctgctgcatgatgtgatccggtatgtaaacgagactgtcgggccggtccctcctcggagcgtataaacagtatacgctcggggcagtaccggccctctcctcaccttaaatcgaaaaattttcgtttttaatatgacaaaacgagaaatattgcaataatttctatttttatgttgcatttcacaaaaaaaccgttattctagtattagaaagataaacataactgcaaacacactgcagaggtccgcacaaaccgcgcaaggggtgttaacgatgaaaatagagcaggtcaaagtgattcttacctcgcccaatcaaaactacttatttgtgaagctgattacggacagcggggtttatggagtgggggatgcttccctgaacggccaggagcatacagtggccgacttcattacctccttcctgacgccaatacttattgggcgtgaccccacgcagatcgaggatttctggcagctggtatatcgcggagcttactggcggggcggaaatatcgtgatgagtgccctgtgcggcgtggacatggctttgtgggatattctgggcaaggtgacaggccaaccgctctaccgactgctgggcggaaaggtgcgggacaaggtgctgtgctactcccacgtgctgggcaagaccaatgaggaaaaagcggcgctggcagccagttacgtgaaagagcggggattgaaggtgatccgtctgcgggccggagccccagctgccaacggaactttgggaggcggtgtacaagacgggccaaaagtggagccttggacgccggaggaagagatctacaacaccgttgaattctttatcagagtccgggagcaggtgggccgggaagtgggaatcatctatgaccttcacgagagattcagtcccgcccaggcaatccgaatcatccggcagttggagccgtatgatccattctttattgaagatccggtggcaccggactgtatagccagcctgcggtcggtgcgggaaaagacatcagtgcccatcgcttttggtgagctctacaagagtcggcatgagtgcttgcccgccattacggggcggctggtagactacatccgatgcgatgtgatccgtatcggcgggattacggaggcacggaagattgccgtactggcagagacctacgacgttaagactgcgtggcacgggcccaacgacgtctctcccattactcacgccgtaaactggcatctgaacgtatccgagtacaatttcggcatacaggaagacggttccgttgacacgctggtaaaacaggtggtgagcggcggaccggtctatcgtgacggctatctctacctggaggatcgccccggcatcggctgcgatattgatgaggcggcagcggaaaagtatcctttccgccgtgcctacatccccgtatgccgcagcagcgacgggagccttaccaattggtgatatgggaaacaaggaggcgaatcccatgaatgaagagcttttgcagatcaaacgctgtcaggatgccggctatcatccgcagatttattttgagggctggcgggtggcatatctgaatgacaccccaaagttccacctggaaaacatggaggatatgcagagacacaatacctctgatgaagtatttgtgctgttgaaaggaagctgcacgctgtatatcggtgatggcggagatgaaggacccggcaccgtccgggcggtggaactggaacccggtgttatttataatgtccgacggggtgcatggcacacccacgccaccgggccggatgcctccgtacttattgtggaaaacgcggatgtgtcgccggagaattctgaccatattccggtgaatgtaggctggcttttccgaagggaggaggagaaatgacccaggaggagcgaaggatcatcgttgatctgcggacgcggatggagcacaatctcaagacctgtatcctccccttttggaccagatatatgactgatcaggtgcatggcgggttttatggccgggtagacggcagcctgcagccggatctcagtagtccaaagagcatggtgctgaacggccggatgttatggacctacagcagagcatgggatatggtgcggtacccggcctgccaggaacttgcccagcgcgccttccggtacatccagtcccatttttgggatgaactttatggcggtgtctattgggcggtgacctgtcggggggagccttctgagctggaaaagcgcacatacgctcaggcatttctcatctattcctatgcggaatactatcgggttttcggttctaaagaggcgctggaccgggcccggcaggtgctgagtctactgaaccgacacatgaagtatcctcagggcggttacgccgattctgccgctcgggactggttgcgggacgactggatcaatttctgggtcaagaacagaaccggtgcggccaagctgctcaattccaacatgcatttgtttgaggccatatacaatctggctcaggcagcgccggagccctggatcctgcagagtctgcgggacgaactggagtttttgctcggtacggttgtggatcgaaagctgcaccacctgaaggcggcgatggatgtgtcgggagcacgtttggatcatgagattaattacggacatgacgcggagtgctcttatctgctgaccggcgcggcagaactgttgggtgatgctgatttaatccggagggcccgggagacggcagtggacctcatggatcacgttctggcggaaggaatggatccggaatacggaggactgtactatatcggcgacagcgccagcggggagatcaaccgtgcgaagatctggtgggtccaggcggaagggatcacagctagctttaactgttaccagtttacgggtgaccggcgctatctggacgcggcggtaaacatctggaactatgtggagcgctatgtggtcaaccacgacttaggagagtggtattccgtcggtctgccgccctgtgatgatacggaactgagggctcaggccgatcagctgaaggaagttttcaataataacgaactagcaggaaagggaaagtgtccctaccacaactccagaacctgttttgagatcatgcgccgggcggatgtcatactttcacctgctggcgcctgtccgtaagggctgtaccgttttgtttattgtgggatcccccacagtaaaatagaaatcgaaaggatgatggaaatgaaatcaacgctgaaaaaggcactgtctcttgctctttccctgaccctcacgatcagccttgcagcctgcggcagctctggcaatactacaccttccactgatcccgcggcttccggcggctctgcagacagcggcgacctgtcccgaattcatttgaaagtgggcggtcaaatccgccagaccagcctgtatctgtactatgcccgtgacatgggtctgtttgaagacgctggcctggatgtggaggtcgttactctggcctccggccccgccattaacgaggctatgactgccggtgagctggatattgcctgctctggcatggccagcgtgtacattttgggtaccggccgtttcacctatgtgtttgataccaccatcaactccggcggccagtccatgtatgcccgggcggacagcgacatcgtcaaggccggcaactacaacggcaccaatctgatcggcagtcccgacaccgtgaagggtgccaccatgattggcctgtttgccagtacggcccagtataacgctattgcctatgctgaggccatgggcctgacggcagaagacgtgaatctggtgaacatggaccatgcccagggctaccaggctttcatctccggtgagggtgacattctctccactacgccgccctactccagcatgctggatgccgatcccaactatgtgatggtggcggacatgcccgacctgatggacggtgcgcctctggtggactccttggtggtgaccaacgagctggacgaaaactatcacgatgtggtggtggcctttgccgagtgctgctttgaagccatggatcagttggccaaggatgatgaactgcgggccgagtatgccactaatctctacctgaacgaaggcggtgtgacctacagcgaggaggatatggctgccgagatcgccaacgtgacctactggacatgggaagagctggagaatcctccctttgagcccggcaccaccatgcgcaccatggcccagttcttcatcgaccagggccagatcgaagcggacagcctgtccaacatcaccgattccctgaagtacgagacttaccggaccgagattctggactaccataattcccactaagcggtttggaggcgccggggcggacagtatctccccggcgcctctgcgcagaaagcgaaaggtgtttccatgaaaggatttctaaaaaaacggcggtacttttttatctcctgcgcttcggtctgtgtggtgcttctggtgtggtttctgtggtgcgacgtgtttaaaatgacggagaccactgtatttccaggcccggtaaaggtgctgactacatttatccagaagctgacccagcgcaatccggataacgccactctgcttcaacatacgatcaccagcctgcagacctgtctgctgggctacgggatcggggcggtggtgggtatccccatgggtattctgatggcctggaacaaatggtgcgaccggttcatccggcctctgtttgacctaatccgccctatccctggcctggcctggatcccgttgtttatcgtgctgttcggcatcggcatcggggcaaaggctatggtcatctttatcaactccatggttgcctgcaccgtaaacgcctataccggcatccagcagaccagacaggaacatatctggctgggcgatgtgttcggtgcatccaacgcacagaagctgttcaagattgccataccctccgctacccctatgatctttaccggcctgcgtaccgccttgggtggcagctggatggccctggtggctgcggaactgctggcgtccagcaagggcctgggcttcatgatccagaacgcccggttgatctctcgccctgacctgattatcgtgggcatgctgtgcatcggtgtggttggactggtgctggatgtaatcctggaggctgtggagaaaatggttgcaaaggggatgaacgccaaatgaaaaagaaaaaactgctgggtatcaatttcctgtgcggcgcggtgtccatcctggcgttcctggtgctctggaacattgcggtccagggtgagttgggcaaaatgctgccgggccccattcctgtgctggaaaaattttttacatctttggtcagtggaaagatcggtcaaaacaccctggtggagcacgccttctacagcctgctccgtgttatggcggggtatgctctgggctctgtggtgggcgtgattctgggcttggccatgggcacctataaaatggtggaggccatctgttccccgctgttccgcatcatccggcccatccctcccatcgcctggatccccatctccatcatctggatcgggctgggggaggatgccaaaatatttctcatttttctggcctccttctgctatgtcaccctcaacgcctggaacggagtcaaaaatgtggatcagcagttggtgggtgcggcccgtatgctgggcgccagggatcatcagatctttatcactattattctgccggcctgcgtaccgtccatctttgccggcctgcaggtagccctctccagcagctgggccacggtgctggccgccgagatggtccgctcctctaatggccttggctgggtaattattgccggcatgaacaacaacgacatgctccagatcctggtgggtatcgtggccatcggcattgtgggtctggttctgtcgattatcttcagaaaggtggaggctgtgctatgtcggtggaacaagagcggaacataatcgagtgcaaaaatgtcagtaagaccttccaaacaccctctggtccattccaggttatcggggacttcagcttgaccgccagagagcatgaatttgtggccctgtttggtcccggccaatgcggcaaaagtaccattatcaacctgatcgccggtctggagaccgtgaccagcggacaggtaatcgtaaatggaaagacggtaaaggggcctggtcccgagcggggtgtggtgttccagaacatctgccttttcccctggttgaccaccatgggcaacgttgagtacggtctgaaagtagccggtgtgccgaaaaaagagcggcgcgctcgggcccagaaatatatcgacctagtggggctccacggatttgagaattccttccccatccagctttccggtggcatgaagcagcgggtgggtattgcccgttcctactgcattgagcccaaggtgttgctgatggacgaacccttcggtgcactggatgcccagacccgctacctgatgcagcaggagctggaccgaatctggcagactgaccggcgcaccattgtttttgtgaccaacaacatcgaagaggcattgtatctggccgacaggatcgttgtgatctccaattgcccggccaccgtcaagaaggaatacgtcattgatatgccccgtccccgcaactacgtgtctcccgaatttctggcgctgcggaaagagattacgagtatcgtggacaagaccatgtaagggaggcagaactatggaactgggcaaagagacccgggaagtgaaagtccatgtggacaatctgaccaagcgattcggcgatctgctggtgctggatcagatctcctttgacgtctataagggcgagctgctgtgcgtggtagggcccaccggctgcggtaagaccacgttcctcaactgtctgacccatatttacgacctgacggccggacagatcttgatggacgggaaaccagtcaacgcaaagaccagcaacatcgcctacatctttcagggcgactccaccatgccctggctcacggtggcgcagaacgtggccttcggtctgaacatcaagcacacaccgcccaagcagcgggatgaactggtggataagtatctggatattgtgggcttgaccaaattccgtaactactaccccaagcagctctcctccagtatgctgcagcgggtgtccattgcgcgggccttcgccaccgagccggagctgctgctgatggacgagccatacggtcagttggatatcgaattgcgcttcaagctggaggacgaactggtcaagctctgggagatgacgggaaccaccgttattttcattacccacaacattgaagaagcagtctatctgggccagcgcatcatgattctgaccaacaaacccaccacggtgaaggagacggtggataacaatatgccccgacctagggatatcgcggctccggaattcattgacctgagaaaccgggtgacagagcgcatcaagtggtggtgattccggacggcggaacagaaatgaggcgatacagcgtgaaaggactggaagagatctttcctggcgagcagggtcccgtcctgctcacttcaccccaggcaatcttttatactacaggattttataccacggccagacggcccaaccagatcggtaaccagtgtgtgctgatggacgagcagttcactctgtttttctgtcccaggaactggggcgacgttatccggccgcagctggacagccaaattacgctgattccttgcgacccgtcgcctgcggccctggccgaagcggtatgccgggctctgccccggaagccggagcggctgggccttgaagaagaaactatcatcctccccctctatctagcgctgcgggagcaactgccggagacgagcctgtgggatgttacctcccggctttatcgggcccggatgaagaagacaccggcggagattgccggcctgcgccgttccgccaacctggccaaggaggccatggaacatgcctgcgacatcctgcgtcccggggtagccgaactggacgtagtggccgagctggaatattttatgcggaaaaacggctctgagggtacaccgtttaccatgaaggtgctctctggagacaacgccctgcggactatcaacctgcccggaaccagaaagctggcgcagggcgagatcgtcctgctggactttggaaccacagtggggaattacgcctccgactggaccagaagttttatgctgggacagcccacccgggagcagcaggctctgtatgagctggtctggcggatcgagcggacctgtatcaataggatccgccctggaatttccctccagtccctgatggacacagccttcgatgtactccgagggcatccgtttgagacatggttcaacccttatctgggccacagcattggcattgacagcgtggagcgacctgctattgtccctggcgtccagggatgtctggaggagaatatggtactaaccatcgaaccgggcgtctatgtgcctggcgtcggcggaatacgcattgaggacgagattctggtcacatcggagggcccggaaattttgaccgggctgcggacagagcgctttgtgctctgaaacagacaggaggtcattatggtcattaccaactggcgccaggcggcgcccaccatcgtgcatcagtacggcatcgactataagctactcaagggtcaggccgatttttcccccgatgtgccaaactactgcatgcggggcatgctgtatgtagcctatgccatgctccagacaggtaagtcctatgaggcccatgcccatggagaccatgaggaggtctattacattattgcgggccacggcaccatgaccataaatggtgagcggcaatccatccgggatggggatgcaattttcattccggcgggggatacccactccatctcaaacacaggggaagaatttttggtgtttttagcctttgctgcccaggttccagaggataaagcaccagtgcagggaaaggaaggatgctgaatgagacggaagaaagctgttgtgaccggcggtagtcacgggattggccgggggatcgtctattgcctggctgaggcaggctatgatgtggtattttcctataacaccgattttgattccgcccagcatatgttggagacgctggccggccagtatccggatggcatatttgactgttatcaggctaagctgaccgagcagggtgctgctgtttcctttttcagacaggcggtggaacggctgggcgggttggatttgatggtcaataatgctggcgtcaccaagctggaaagtatctttgacctgacggaagagaccatggattaccttgtcaatctgatgctgcgtacctatgtgctgatgatgcgggaggctgccacttatatggccaaccagggaacccggggcaatattatcaatatcagctccacccgtggcctaagtgctcacccgggcgacgctatctatggcggcatcaaggcggcccttaaccggatcgttcagtccgttgcactggacgtagcctcctacgggatccgggcgaacaacatactgcccggcgccaccaagcgctttacgccggaggaagaagccaaaacagacccggcccatctggaaaaggtggcctatctgtcccagcgcattccgctggagcgttatggtacaccggaggatgtggggaatctggtggtattcctggcctcggacaaggcttcctatatcaccggccagagcatcgccattgacggtggcctttccctgcccggcctggcggagactgcagctgagactgcggccagcggctggggacgggtaaaaaaggaaatccgctggcaggatgcctgacctgtggacataaaaataaagttgcgaggcgaaaaataatggatctgatggaacgcttttcaaatgcaggtgtcgttccggtggtcgtcctagaagatgctggacaggcgctttccacagccagggctctcctggcgggaggcattgacgtgatggagattacgttccgcaccgatgcagcccgggatgcgatccaaatcgttgcggaacagtgtccggacatgctggtgggagcgggtaccgtgtgctcggtggagcagtgcaggcaggcggcagaggccggagctcggtttattgtttctcccggctttgatccctgtgtggttgactggtgcctggaacacgagcttactgttttacccggctgcgtcacacccagtgagatcatggaagcactgtcgcggggaattagcacagtcaaatttttcccggccagcatctacggtggtttggaggcaatgaaagccctctccggtccctttgtggggctacagtttgttcccacaggagggatcaacgccgcaaatctggcagaatatgcgaaagctccctttgtgcgggctgtgggcggcagctggctgtgcagccgctccgatatcgcccagggacggtttgaacacatcacagaactgtgccggcaggccaagaatatccttgccggcctgtagggacaggagaatggagtggttcagatgaagtacttaacctttggcgagatcatgcttcgcctgaagtcccctgggcacgagtgcctgtttcaaaatggaacgctagaggcaaccttcggcggcggggaggccaatgtggctgtctccttggccaattttggtgtggatgctgcctttttgactgtcctgccagataatccggtgggttccgcttgcatgggggagctgcggcggttcggcgtagataccagccgtattctcacccggcaggggcgtatgggtatctattttttggaatcgggtgccaatcaacgaccttccaaggtggtgtatgaccgggcaggctccgccattgcccagacggcacctagcgagatcgactgggatcaagcctttgctgggatcgggtggttccatatcacaggcatcacccctgccctttctgaaagcgctatggagctgtccctttgtgcggtcagggaggccaaagcccggggtgttaccgtttcctgcgacttgaattatcggaaaaatctttggaaatacggcaaagaggcgcctcaggtcatgcgggaactgacaaaatcggtggatgtggccattgccaatgaggaagacgtgcagaaatcgctggggatctcggcggcggtggatgtgactgcaggccagttggaccgggagaagtaccgggcattgggagaccaggtgctccgtgaattccctaacctgcgtttgattgccatcactctgcgggagagtgtgagcgcggatatcaatggctggtccgcttgtctgaacaacggcagtaaattttacacctccaggcggtatgagatccgggatatcgtggaccgggtaggtggcggagacagctttgccgccggcctaatctacggactgactcattatcagaaccaccaggaggcactggaatttgcggtggcggcctcctgtctcaagcactccatactgggagactttaaccgggtaagtgtggcagatgtggaaaagctgatggctggagatgggtccggccgggtacaacgttgaaaaatggtgcggcatcctgtctataggcaggatgccgcaccatttttcgggttttatcggattcggctgcttagtacagcatccttgaccatatcaaggcgcgctttagccccaggctggtggagaatttccgcctgcagtacgcccaaaatagccacctcacagatactgcccagatggaggtactgcaggtcgtctgggatgttgtagctatatagcagcgtataatccgctaatttttccaaagtggaattgggattggcggttatagatacgatggtagccccgctgtctttggcattctgcagagcgtgaatcacggaacgactttctccgctatagccaaatccgatagccacatctccttttctcatggtactggcggcgatgctcatatccacattatcattaaaagcctggcttcgaatccccacgcgcaggagcatctgctgggcatacagagcggagatgtagccaccgctctgaccgaatagatttacattgggggcctggaagatagccttggctacggcggataccgtttccacactcagcacacgcagggtatctgtgatcacatcctgggcgctcttcatcagcttctggagaatgacggaggtggtgtccgcctcctgaatgggtgcatctacaatggaagccgaaataaggcccttttcaatgtacaccttcagttcgctgaagcccttaaaggacaggatttggcagaaacgggtaatagtagacggcgcggtgttggtcttttttgccagagtcgaaatggagtaatgaataacttcttgctgatgcttgaaaatgtaatttgcaatctgacggtgtttttttgacagagaagagtactgtgcacgaatacggctgacatattcgatattaccatctaactcagtacgcaaatattgtgccatcccgtttcctccttctgccagtcaattatttattattatactagctatatcgataacacgcaataaagataaaaatcaatcaggtttaaccatatagaagaaacccgtggggtgataggtatactttgtgagatggtttatcagagcaactctagttgcctttttagctcagtatccgtcagttctccacgaccggcttgctccataagttcctgtgctttcgccacagcgatgttccactcgtcgatactgatcttctttcggttcttcctttgctttagccggttataggtgcggtcatactccacctgggcaggcgtgcggttggccttgccctgcgcctcctttcggtgagcgcccaccttccggcaggtgcgctccgtctcgcccggcgcaatgttgttgcagtagcaggtgttgtagcctgcggtcagcaaaaaatacctgccgcaattgtggcagcggcgaggtgcgttgccgatggcaagcccccggtaaaattcggtccgcaaaaaatccagcagattattgaacgtggttttttcggccacaaacactttgccctcttctgtggggtgcatcatgggaacgaaactgacctccaccggaaagctctggtcaaaatcctcgttaaaataatgtgccgcgatggaggccatctggctatagaacttagaataggcgtctgcataggccgcgctgtttcgtcgcgtcaacggctcaaagtagaactcggtcatagtagcgatctggccctggaacatacggatgcgggccgcaagactagataggccctccatgaactcctgatacatagtgtatccctctgtgccgggcgtttgaatctgcatccatttgtcgctctctgtcagaagattctccagggcgtgataactacattccctgtcaatttgcaaatcccgatacccaggcaaagtaaatacgacatcccagacagcgtttagtttctcctgagcggaaactacagcgatgtctgttttttctgtcagcaggcgttgagctgcaggcaggaagtcctgcacccgctgatagattttcatcaaaatttcttcatcaaggttcaaaatatccacactgcactgtccggtagggaggctcttttctccgagaaagacccggtcaccataaaagaacactgtaaactggtcgtaggtataggtatatgggatgaatatcccctgtgtctgattgtccatgtaactccctccgctttgtaaccgatggagatttgagattttcccaatgcgccctaattctattgtgttaagggttaacctatggtaccctgtcgccacaacgcaagtgtatcagatgaaaacactcgggtcaatcgggaggaggatcacaatgaaatcgccacagtacaaaagttatgatgagttaccgctgtttctcaacgcaaatctggtagcccaggtgctgggcgtgtcgcagtccagcgggtacgagctcatgcacgaaccgggcttcccggtactgcgtgtgggcagccgcatggtggtgcccaaggaacaattcatccgatgggtcacggagcacacggagggaggtgagcacaaatgaaccagcgtcgtttctcaattcccaatgacatctggaagtggaatctcaagccgcagggatttgcgaccctcgcttatctctgctatctgcacatccactgcaacaaaggtgcctcatccagtgcggatgaaatcgcatcccaactgcacatgagcaaagacatggccgcagagcagctctctgaactcaaccatcgcgggctgctggatcagcacatggttcccgtcttcaaaaacaccagcaagaattttttctctctgcccaatgagctgttcttcctgaacatcggtcacggggtcatcaccgtctacgcctatctgctctactgtgaagaccgtcgtacccatcagtgtcatcccagctaccgcacgatctcagatgtggtacatcttaccgtgtccacggtgatgaagcacatcacgaagttggcggacaggcagttcatcacggtggagagcaccagctacattgacaaacgcggtatgaagtggaacggcaataacctctacaccatcctgccaatacaaatggcgatggattattgctatcaacagcagttgcttcgcctggaagcgtaaaacgcccgtgtgcccggctgtgaggcgctgtgtgccctccttctgggcagagcaaagcccagccccacctgggggctttggggacggattaggccgctttcgagggacgaaagaaggagcgggataaaggcaaggcgtcaacatcgacgccttttccaatcacttctgcccgcagtgcgggcagtttcaggaggtttccgtaggcgttgcaaatggggtcaaaatcagagagaacaggaaatcttgcggtcgttatccccaaacgcttactcccacaaggaaaaaacaggggtcaagccccggaaaggaggctgttatgagcccgaaagagaaattccccctctacctgtcgccggagaaaaaagcgacactggagcggaggcatacggaagatggcagccggagcatcactggatttatcgaaaacgccatcgacttctacctggactatctcagcgccaacaactccggattgttcctgccctccgccgtccagtcctatctggatggcaggctgaaccagatggaaaaccgtatggcgtcgctgctcttcaaacaggcggtggagttggacatgggactgagtatgctgttcaagtgtgtcaacgtgagtgaggaggagctgcgccgtcagcgggcggagagcgtggccaacgtgaaaaaggccaatggcaaggtgtcgctggtacagaagctgcgggagctagaggatgacccatggcaagactgatcgtcaagagcccgtatatcaagtgcggcggcggacagagcgcaggcggctacatgaagtacatcgcaacgcgggaacgggtggagatcattttggatgaccgtccgcccacacgcaagcaggagcagctcatcacaaaactggtaaaagattttcctgacacgaaaaatctgctggagtatgaggactacgcacagcatcccacgaaagccaacgcctcgtccctcatcactctggcactggaggagaactggtcccaggttcaatcctcggagggctacgccaagtacatcgccacccgtccacgtgcggagcgtctgggtgaccacgggctgttcggagacgaggacggtgtggaactggacaaagccatgttggaactggagcactacactggaaatgtgtggacacacatcatctccctccaccggaaggacgccgcacgtctaggctatgataacgcccaggcgtggtgtgcgcttttgcgtacacaccgcaacgatatcgccgccgccatgaatatcaagccccaggacttccggtggtacgctgcctttcacaatgaaggggagcatccccatgtgcacatgatggcgtggtcggcgaaccctggacaggcctacctatccagggacggcatccggcagatcaagtcagccctcaccaatcagatcttcaaacaggagatgctccacctctatgagcagaagtctgaaagccgggacgaactggtgcgggagacccggaaggccatgctggaactgtcccggcagatgagcgaatcagtctgtgagcatcctgaagcagagcggatgatcttgaatcttgcccagcagcttggagaggtaaagggcaagaagtcctatggctatcttccaaagcggataaagcgacaggtcgatgagatcgtaaaccagatggaacacctgcctgttgtggataggtgctaccagaagtggtgggaactgcagtgcaaagtgaatgactactactctgagaaggagcggcagcgcccgccgctctctgagcagaaagagttccgtgccatcaagaatgcggtgatccaggaggctgagcacgtccggctgaaccacatctctttcgaggacagagatatggaagactacggtgactgggtgaatgaacgatcactcacctggacctgtcgggagttgtggagacttgttgaaaacgaggcgctaccgttggaagaccgggacgaggccgccgagaggctggaactgctggcaaagatgggcgacccatacgcccagaccttcctgggacagttgtaccgggacggcggtttgctgattccggatgcagagaaggccaggcactggctggagcaggcggcggagcgtgaactgcctcaggctcagtatgcgcttggaaaactgcttctctcagacgacccagatgtgtgcgatcccagcgaaggcatccgatggctgaacgcagccgcgcaaaacgggaacgactatactgcctacgctctgggaaaggagtatctccaaggagatcatgtactcaaaaacgcaaatacagcggcggaatatcttcatcaggcggcagaggcacagaacccctgggcacagtatctgttgggcaagctgtacctgatgggggagggggtggaacaggatcaggaggttgcctatggctggttccaagctgcggcaatgcaggggcacacctatgcacagtttttcaaggaacgcatggagcagggcccgcccggaccgcccagcctgatgctctctgccacgcaactccttcaccacatgggcaacatcttccgggacaatgtgccggaggattccacaagcaccggactgcacattgaccataagcggctgcaggcgctccaggaaaagcggatcgccctgggccacagaccggatgaccatgtggagcagacgaagggtggtatgaccatgaggtagaggtaaaaaactccccgccagttatggcggggagcaaagtaattgcagaatgaagcagctgcggtcttgtcgctgttgttgggctccaggccccagttctattgtcacgagatggtcaggtcggaaaatgaattttgcccttgctgcaggcgaatctgtgccgcacaaaagtcacgtaattctataatcccggtctccgaggtctcccatattgtatcaatgtcaatatggccatactcatgagcaactacatttcgcataccgcgaattgctttccacggtattgtggtatgcgactggacaaattcatcagaaagtttcttcaccaactccccaatctgcaaaaggcagagcgcaatcgcgttccgataggtcggattgctgcaaaaggtgttgtagttgcggtcatactccgtatgggtaaacatgatgtcatcacagtacccctggatcttctgtaggatctggatgtcacgattgggtatggtcatataacagcacctcctcctgcgcaatatgactgaggaattgctggtccagactacccgtggtcaacaggtccagctttttcccaagccgttcttccaggtcgctgtatagtgcccccaaagtaaacagccccttcacatttcctttgtctatgcgcaggtcgacatcgctgttttctgtggcctgtcctctggcataggagccaaaaaggaagatgcggtctacaccatattgggcggcaataggggatatcaatgctctcaattcgtctatcgcatagattttaccatctgtcatgtaaacctgcccctccctaaagtgtcgtaaagtaaggctacatctgcattgtagcataagaattttatagttgcaaatcgaaaacgcggggtgattttaatacagtgtataacaaagaaagtcccctgcaaatgataacaatttgataactgtggtcaaaaccactggctattcctctaagattagggtattgtgtgttgctgcaaaggaggcggcacacatgggctactacatgagcgaactgtaccggcgctacttccgggccacggacttcagcgagctggaggaagaaattgaaaacacccgtcaggaggtgcgggactgtctggatcaggcgcagcggcgggagctgatgcgcctggtggatgcgcaagaccaactgaaagcaaaccttgcccaagccagcttcgaagccgggttccggctggccatggggctgctccaggaggtagaggtggagcgtatccggctcgaactgaaagaggaggggcaaacgtaatgaatatacagtttcccgttcagcaatgccaatactgtgggagcacgaatatcggtctgggctggcagcacggcgaggcgctggtgaccttcaaaaaacacggcctgcggggcaaccggctgcagtatctgatttgccgccgctgcggtgctgtgctctaccagtgcgtagccgaacctcacagattccccgctgcaaaataagggctcagaaattgcgccgcaaaacaaaaatacgactttgggggtgaagcaaaatggcaaagagacggccatccggagacggcatggtgcggaagagggaagacgggcgctgggagggccgcatcgtcatcgggcataaggaaaacggcgactccatcttccgctacatctatgccgacacccaaaaggaactgactgccaagctccggcagaatatcaacgcctatcagggcgtggatctgaccgaggagagcaaaatgaccttatcccagtggctagacaagtggctggatacgtacatgacaggaacggttcgggagagtaccctggatgggtaccggagggatctgaacaatcatgtcaaaccctatctgggagaaaagccgctactcaaaattactccggcagatttgagtgaactctatcaagcgcttctggagcgcggacgagtggtgaggaagaaagcctcaggctttggcctgagcccgacaactgtccacgggattcaaaccaccctgcatcacgccctgagaacggccgcagaggagggattgcttccagccaaccctgccgatggagcgacaccgcctaaggtggtcaacagggcaaaggggattctcaataacgctcagttggacacattcaaggcagcaatccaaaaggattggatctggcgggacttcttcctcaccgaactgactaccggactgcggcggggcgaactgtgtggcctcaagtggtcagactttgatgaagaggccgggacattaaaagtatgccgtaccatccatgccaggaagggcggcggagtggaggcgggaagcacaaagacctatgcaggaacccggacaattctgcttccgtccagtacagcccagcttctgagggagcgaaaaaagtctgccctgacagagtggatcttccccgatcctctctgcccggagcggccggtcagcccgggcagcgcataccggaggttaaaaagtttactgggtgaggccgggctgcctgatcttcggttccatgacctgcgccacaccttcgcgactcatgccctgaccagcggggtggacgcgaaaacgctctctggaatcctggggcataccaaggccagctttaccctggatacttatacccatgtgaccggggacatgcagcgcggcgccgctgagatcgtaggcggctttctgaccgaactattgggagaggagttggaaccgtggcaaagaaacgaaaacggggagatggcagtctccacctgagaaaggacggccgctgggaggggcggtatgtggtgggccatgacgagaagggccgaccgaaaaccaaaaatgtgttggcaaagacaaaaggagagtgtgcggcaaagctaaaagcgctgaaagagagcctcaaaggcttagagctggagcgccccaggggagaagtgaccttcggaatatggatggaccgctggtatcagacgtactgcaaaccggccatcaagcccaagacccaggcggactatgaaaaccggatctatcagcacatcatcccggagctgggacacacccctctttctcagcttacccaaagcgacctccagcagttttaccaccgcctgaagcagggcgggcggcttctgcgggcggagcaatacggccctggcctgtccgaccgtatggtgaaaagctgtcatgtggcctgccgcatggcgctggacaaggcggtggcggatgggttgattctgaaaaacccagctgcaaactgcaaagcgccagccacccatcccagagaaatgtctgtactgaccggagaagaaatccagcggctgctgattcaggccaaagaggacggatgctatgaacttcttctgctggagctctccaccggcctgcggcggggcgaaatcctggccctgcaatgggatgacctggactttcagaccggagcgctcagggtggaacggcaggtacagcggatcagaggagaactggtggtctccgagcccaaaaccagaacatccagccggagtgtcatcctgcccgcaccgcttctgaaagtgctgaaacagtatcggaaaacctgtatctctcggtggatgttcccctcgccaaagaaagcggattctcccttggatccggcggcggtgcggaagaaactggccgctgtcctggaacgggcgggctgcaagcgtgtccgctttcatgatctccgccatacctttgccaccaacgccctggagcatggcatggacatcaagacactgtccgccatcatcggccatgtgtccagcgccacaaccctgaatgtctatgcccatgtgacagacgagatgcgacaaaaggctgctgatcacatcgaccgagggatcgccggtgtggagccaccctcaaaacccgcatggaaaaaggaaacgacacccacgcccttccgggcggtaaagggcaagtaccgcaagccgggaaccgggtgtatgacccaaatcaacgaccacctctgggaagggcgttactccccgaaggtcgatggaaagcgcatcgctcgaaacgtctacgctcctacggaggaagaatgtgagcagaaactggcagagctgattaaggagatgaaaaaggagctggagccccttcgggccagggaaaaagcctgctgagaacagaaaaccgccctccggaaaagcaattccggagggcgtcgatttttcctgtctgtggctgttatgtggtcaaaaacaatttgacagaatagcgtgaggaagaaaatgaataaaaaagtaacaaaaaaccgctgttttctctcgaaaacagcggtttttctggtggacgatacaggacttgaacctgtgacctcccgcacgtcaagcggatgctctaccagctgagctaatcgtccagacagcgtagattattatatccgtacaagctctatttgtcaatactttttttgattttccccttttcaaaggggaaaccggctggtatactcggatcaaagtggattggaaaggggtggcgggcatgctctgccgacgggtctctctggaggagctccatccggcgctgggcgggggcgccccggagacggggctggacatatactgccggggccgcaccggcctgctggccgacgacggggcgcggtgggcggtgctgatcctccccggcgggggatacgagcgcattgccccggcggagggagagccggtggccctggcctttctggccgcagggatacaggcctttgtgctgtcctacagtgtgctgcccgccctctggcccaggcaattcctggagggggcggccgctctggcctggatgcgggccaacgccccggagctgggcttccggcccgaccaggtggcagtgtgcggcttttccgccgggggacatctggcgggctgcctggccggcgggtacgccgagcccctcctgaacgagcggctggggctgacgccggagcaggtgcggccggacgcggccatactgggctatccggtggtgcacgaggccctctatctggaacccctgggcggggcggaggtgctgcggccggaccgccgggtgggcccgggccacccgcccgcctttctctgggccacggtgggggacgccacggtgccggtggaaaataccctggactatgcccgcgccctgcgagcgcggcaggtgccctttgagctgcacctgtttcaggacgggccccacgccatggggctggccgaccgggagagcgcccgggacgaggcccactataacgcccacgcagcggcctggcatccgctgtgcatagactggctgaaaggaagaggatgatggagcagaaggtggtcctgatcaccggcggaagccggggcatcggcgcggcaaccgcccggcgctttgccgccgggggctgtaaggtggttatcaactaccaccgttcccaggcccaggcggaggccctggcggcggagattggaggctgggcggtgcaggcagacgtggccgatccggtccaggtgggaagaatggttgacaatgtgttggataaattttgtcaacttgacattctgatatgtaacgccggcattgcacagcagaaattgtttggcgatttgaccgatgacgactggcggcggatgttcgccgtcaacgtggacggcgtgtttcacgccgtccgggccgccctgccccacttcatccaccgcaaggcggggcggatcgtcaccgtgtcctccatgtgggggcaggtgggcggctcctgcgaggtggcctattccgccgcaaaggccgcagtaatcggcctcacaagggctttggccaaggagctgggcccctcgggcatcacggtgaactgcgtgtctcccggggttatttccacggaaatgaacgcccatctggaccgggaagccctggccgccctggcggaggagacccccctgggggccatcggcaccccggaggacgtggcggaggctatctggtatctctcctccgacgccgcccggtttgttaccggccaagtgctggcccccaacggcgggctggtaatttaagtgtccgtttcacaatttgttcatattttacacaagggcggtctctcacaggccgcccttgtgtattttgctagttgacaatttcaagtgcacagaatataattgtcaacaacttcaaaggaggataccactatgaaaaagactcgcttcctgtctcttgcactgacgggtactctctgcgtgtccctgctggccggctgcggcggcagcggtgacggcggcggggcagcccagacccccgacgcggccaacaccagcaccgtccaggagaacaccggctccgccttcaagctgggcggcaccggccctctgactggcgacgccgccatctatggcctggctgcccagcgcggcgcccagatcgccgtggatgaaatcaaagaggccggcggcgacattcagttcgcgctgaagtacgaggacgatgtgaacgtccccgagactgcggtcaacgcctacaacgccctgaaggagtggggcatgcagatctccctgggctccgtcacctcccagcccggcgtcagcacctccgccctggcctttgaggaccgcatctttaccatgaccccctccggcagctcccccgatgtcatcagcggcaaggacaacgtctaccagatgtgcttctccgaccccaaccagggcctggcctccgcccagtatatcactgagcagggcctgggtgagaaggtctttatcatctggaaaaatgacgatgtgtattccaccggcattaaggaacagtttgtgaaggaggccgagaccctgggcctggaggtggtgggcgaccccacctttaccaccgacaccgccaccgacttctctgttcagctcacccaggcccagcaggccggggccgacctggtgttcctgcccatctattatcagcccgcctccctgattctgagccaggccgacgccatgggctacacccccaccttcttcggcgtggacggcatggacggcatcctgaccatggacggctttgacgcctccctagccgagggcgtcatgctgctgacccccttcaacgccgacgccaccgacgaggccaccgtcaacttcgtgaccaagtaccaggagctctacggcgaaacccccaaccagtttgccgccgacgcctatgactgcgtctacgcctacaagatggccctggaggccgccggctgcacccccgacatgagcaatgaggagctctgcgacgccctgattgccaccttccccaccattaccctgaccggcctgactggcgacggcgccggcatcacctgggatgcctccggcgaggtatccaagagccccaagggcatggttatcgagaacggcgcttacgtgggcatggactgatcgccagtcccagcgttcacaaaacacggttccgggagggctgccggcacggccggcggccctcccgccaactgcttacacagaacaaatggatgattgcggccgggcaacggcccgccattgcccggccgcaatcatccatgacagagaggtgtgtgttatggtcttcctcaactacctgatcaacgggatcagcctgggcagcatctacgccatcatcgccctggggtacaccatggtctacggcatcgccaagatgctcaacttcgcccacggcgatgtcatcatggtgggcgcgtacatctgctttttcagcatgaacgggctgtcctccctcttcgccccgggcagcctggccgcgctggtggttcccgccctggctggtacggtgctggccatggtggtgtgcaccgtgctgggcatcaccatcgagcggctggcctacaagcccctgcggcaggccacctccctggcggtgctcatcaccgccatcggcgtgagctacttcctccagaatgcggcccagctcctgtggagctccagccccaaggtatttacccccgtggtgagcccgtccgccaagctgaccctgtttgacggccagctctccatctcctggctgaccatcgtgaccgtcctggtgtgcgtggccatcatgctggccctcaccgcctttaccggccgcaccaagatgggcaaggccatgcgggcctgctcggaggacaaggcggcggcccagcttatgggcatcgacgtcaaccgcaccatctccatgacctttgccatcggctccgccctggcggccatcgcaggcgtcctgttcctgtccacctacaccagcctgacccccaccaccggctccatgcccggcatcaaggcctttaccgccgccgtgttcggcggcatcggctccatccccggcgccctgctgggcggcctgctgctgggcgtcattgagacctttgcccgcgcctacatctccaccgagctgtccaccgccatcgtgttcggtgtgctgatcatcgtcctgctggtgaagcccgccggcctgctgggcaagaccgtccgtgagaaagtgtgaggtggacgcgatgagacaacttggacagatgaaaaaatccaccaaaaacagcctgtttacctacacgctggtcattgcggcctttgtggtggtgcaggccctgcggatgggccctggcgtgggcgccatgctggaggggcagctcatccccatctgcgcctacatcgtcatggcgctggccctgaacctggtggtgggcgtctccggcgagctgagcctgggccacgccggtttcatgagcattggagcctttgccggctctgccctggccctggctctccagagcaccgtcaccctttcccccctgcgcctggccctggccatggtattcggcgcggtcatcgccgccgcgctgggctttctcatcggcatccccgtgctgcgcctcaatggcgactacctggccatcgtcaccctggcctttggcgagatcatcaagagcatcatcaccaacgtctacctgggcgtggatgaaaacggcctccagttcagcttcctctccaacaaaaacgagctggccgacggcggggtggagctcatacgcggccccatgggcgtgatgaacacccagcgcatctccacctttattgccggctttgtactggtgctggtggccctggtggtcatcttcaacctggtcaacagccgcaccggccgggccgtcatggccgcccgggacaaccgcatcgccgccgagagcgtgggcatcagcgtcaccaagtacaagatgatcgcctttgtggtttccgccgctctggcgggcgcggcgggcaccctgtacgggtgcagccagaccaccttcgccgccaccaagttcgacttcaatacctccattctgattctggtgttcgtggtgctgggcggcctgggcaacatgtggggctccgtcattgccgccgccgccctcactatcctgcccgaggccctgcgccagttctccaactaccgcatgctggtgtacgccattgtgctgatcctggtcatgctggccaccaacaatcccaccctgaagggcttcttctcccggctgttccaccgggagcgggcggacgcgccccatgcggcggcggtgaaaggaggcggcaagcagtgagcagcataaagcgacccgagaccaagctggtcccggtgcccagcgtcaacaagattccagagcgggacgtggataagagccccatcctggaggcccagcacctgggcatcgacttcggcggcctcaccgccgtcaacgagttcaacatggccatcggccgcaccgagatcgccggcctgatcggccccaacggcgcgggcaagaccacggtgttcaacctgctgaccaaggtgtaccagcccacccggggcaccgttctgctggacggagtggacacccacaacatgaacacagtgcaggtcaacaaggcgggcatcgcccgtaccttccagaacatccgcctgtttaacaacctgagtgtggaggacaatgtcaaaatcggcatgcacaattccatccactgcggcctgttcagcggcattctccgcctgccccggtactggaaggaggagaagaccgcccatgagcgggcgctggagctgctctccatctttcacatgcaggatctggcgggggccaaggcgggctccctgccctacggcgcccagcggaggctggagatcatccgcgccctgggcaccaacccgtccctgcttctgctggacgagccggcggcgggcatgaacccttcggagaccgcggagctgatggagaacatcgtcaaaatccgcgacaccttccagattgccattctcctcatcgagcacgacatgaacctggttatgggtatctgcgagggcatctgcgtgctcaacttcggccagatcatcgccaagggcacccccacggaaattcagaacaacccggaggtcatcaaggcctacctgggcggcggaaaggagggctgagagatggctgtgatgctggatgtcaagaacatcaacgtctattacggcgccattcacgccgtcaaggacatctcctttcaggtcaatgagggggagattgtcaccctcatcggcgccaacggcgcgggcaagaccaccacactgcaaaccgtgtccggtctgctccacacccgcaccggctccattgagttcctggggcagcccatccagaacgtccccgcctccaagctggtgggccgcggactggcccaggtgccggagggccgccgggtctttcagcagatgacagtggaggagaacctggagatgggcggcttcacccagcccgcctccaccatcgcccccggcctggagcgggtgtacgagcagttcccccggctgaaggaacgccgccgtcaggtggcgggcaccctgtccggcggcgagcagcagatgctggccatggggcgggccctcatgtccaaccccaagctgctcatgctggacgagccctccatgggcctggcccccctgctggtggagcagatcttcgacatcatcaaggagctccaccgggcgggcaccacgattctcctggtggagcagaacgcccagatggccctgagcgtggccgaccggggctacgtgctggagaccgggcgggtcaccctcaccggccccggccgggagctgctggccgacgaggccgtcaaaaaggcatacctgggcggttaaacggcagcccggcggagcgcgctccgccgggctccgccagtcgaaaagggcttttcgactggctgctgaactttttgaaactttaggaaagtttcaaaaagttgtttgatccaacgcgaacggcccaggccggactttcttggcctgcggccaattcacctccagggaaccctgactgttcatccccgcgccaagcgccgccgcaaagcggcggttgcgctccgaatcgccctgcggggcagcctttcacactatccctccctccgaaacctttggtaggagcgtttatcgacagccccagcccggcggagcgcgctccgccgggctgttttccatttcctccccttgactggcgtgctataatatggtcagcaaggcaatatcgccgcgttgtgcaaggaggcgctgatccataccatgcccaattactacgcgcacctgacgtttggccaacgggtgctggcggacctgcccgccggcctgtccgagctcattgagcaggagcgggaggcctttgacctgggctgtctgggccccgacccgctgttcttctaccagcccatccgccccaacgccgtccggcgggaggggatcaagatgcaccgccgctccgccctgcccgcggtggagcgtctgcgccaggctatcgaggacggcgtacccatgtccaccggctacggagctggcttcctctgccatttggccctggacagcgcctgccacggctacgtggacgaccgggccgccgacggccccatctcccacatggccattgagggggagtatgaccggatgctgatggagcgggacggcctcaatgccgccgagcagtccccactgcccagcgccccggccaaccgcgccgtctgggaggcggcgtcccaggcctttgtccacgcctcccccgaccagatgcggcgggcctaccgctccatggccttcttctccggcttcctggcccgctccaacggccgcatgaccggcaaggtcatcggtgcggtgagccacatgctccccattccctccgccaagggcatcgccctgaaggagacgccccacccctcggcgcaggagagcaacgccgatctcaaccgtctgctggaggcggccatccctgagacagcggagcagatcaccgcctttttccaggccatttcggcggaaactcccgtgccccgctggttcgaccgggacttcaagggcaatccgccccccatcccccagcgcatccgctggcaggacatcccagagcactccgttacatgacaagcgccgcccccgcattgtgggggcggcgctttctcattgggcctccaacaggaaggtcaccgggcgcagcccgtcggtacagcacaccacattgaccccctcccgccgctgccagggggtataggaggcaccgcaggacagggcggacaccgagcggtagagatcgatccacgcccaggggcagaagccggctggcatttccgcgcccccggtatagaggaactgatccccctcccggaagaagtcgcagacgcactcctccggaggctcggtgaggtgctcccggatcagatcggggtaaaatcccttgcgcagcacagtgattttcacgttcttcatggtgcaagctcctttcgctcctccggttcgttttgaaactctgtcatggtgccccagaaccgcttgggcatctgggtcatgcggcaccgggggttctcccgcccctcgatggcgatggtgtcgtagaaccgccgccacaggcggcggaagtcccgctcctcccggccgggggcggcggcgcggaacgcctctaggggcacgatggtccaccgccggggccggtaaaacagcgcctcccggtgggtgcggtcgtagaggacgaaggactcctccggatagcgggcgcagaagtggggccggaggagggggagcacccggtttttgggggcaatttcccccaccagcaccccctcctgctcggagaagcgtgtgaagcccttgagcagatgggcctctccggtcaggtggcccaccgcgcgggtcagcaccgccacccggtcgtcggtgagatcccgcaccacccacggcccccggtcgtaccccaggcggagaaaccgccacaggtggagctcccgctcctccaggcaggtgagaaagccgtacaccgccagccgccgcccctcctgtcccagcctgggggccagggagcggtacacccgctgggcgcgggcctcgtcggtgtccaccgtccgctccggccagagggaaatccgcccgtcctccggggtggaaaagctcatgggctcctcccggtgggcgtagctagcaaatacacaggtcaaaaagccggcaaagctgccgtcataggcataggaaaccggtgtccagtccatggccgcctcctaacccgtctgctcgaagagggagagctgctccggcgcgccctgggccagcatgggccgctcctgggccaccaggtggcggagcaccccgtcgggggagacccgcaggccctccaggtacttgccgccgcaggtgaggaaatactgggcccgcttgagcaccacccccagctttttcagccccgcaaaggtgaggggcgcgcaccggcgggcaaccaggatgcgccgggcggaggtcaccccgatacccggcacccgcagcagggcctcgtagtccgcccggttgacctccaccgggaagaactccgggtggttcagcgcccaggagcacttggggtctaccaggggattgaagttgggattggcttcgtccagcagctcctcggcccggaagtggtagaaccgcagcagccagtccgcctggtagagccggtgctcccgcagcaggggcgggcggaaggactggggggcggggaggagcctgtggttggacaccggcatataggcggagtagaatacccgcttgagcttatacttgtcgtagagggcctgggtgagggtgaggatgtgcctgtcgctctccggcgtggcgccgataatcatctgggtggactgccccgccggggcgaagcggggggcgtggcggaaccgggccagctccccccggctggcctgaatgccatcccggatctgggccatgggggccaggatggcggccttggccttgtcgggcgccaggcggcccaggctctcctcgctgggcagctcgatgttgacggacaggcggtcggccagcaggcccagccgccgggtgaggagggggtcggcccccgggatggccttggcgtggatatagccgcggaagccgtactcctcccgcagcaggcgcagggcctcgatcatggcctcggtggtgcggtcggggccgccccacacggcggaggagaggaagagtccctcgatgtagttgcgccggtaaaagccgatggtgagctccgccagctcccgtggggtgaaggcggcccggcgcacatcgctggagcggcggttgacgcagtaggcgcagtcgtagacgcaccggttggtaagcagcaccttgagcagggagatgcaccggccgtcggcggagaaggagtggcagcatccggcggccagggtgctccccaggccgccgggccggcccgcccgatccagcccgctggaggtgcacgccgcgtcgtacttggccgcgtcggccagaatggtcagcttgtccagcagctccacactgccgccccctctcctttttgtttagcttcattatatatcaaacatttgttccagtcaagagggggataatggaaacccaccccggagccgaggcccggggtgggttgcttggttactctcccatgtaggagaagtgcatatagtcgtggtagccctcggaatcgtcgctgctgtaagcccaggcgtcgccgccccagctccagccgtgctcggcaaagatgcgcaccacggaggagtcgggggagatggaataggcattgctccccggctcccagcagctcccggccagcacctgaccgtcgcggatctggtagttctcgttggcgttgatgtcgatggcggtgccgcagttgtgctcgccggtggcggagtcgccccgccaggtgtagccgcccacgtcgtggatggggaagcgctcgggatcgttgtagatcccggtaaagatctccttcacgtcctccgccagggcggcgtggacggagagggtgagggtggaggacaccttctccccgccggagagctgccataccggcacggtgacggtggtcatagcggcggcggcctcctcctggctggcaaagcggctcttgctctcgtcgccgaagaggaggatgtgcttgcgggcgttgtccccctgaaagctgagccagaagtcctgcttatagtagtcctcataggcggcctcgccccgctccaccttctcccagaactgctcctcctgaatctcggcctcggtcatgggccgaaaatacagggtatagccgtcgcaggcagtgctggtatacgatgccgtctcccggtcgtagtcgtagacgtagtagcccacatccagcccgttcgccaggctggacaggtaggtactcacctccgtctccacctgctggtcgggcaggagggcctcgccggtgtcggcgttcagaatgtgaagggtgacggtctggctctcaccgcggcagctgtcgtccacctgctccagcacccgcatcagcagcaccgcgccgtcgcagcgctgaaggggatcggcatagccgaaggagccgtcggccttgccctggatgacgcagcggcgggccagctcggccaccgcctcctggcggaggctgtccatcctcccccagtccgacagggctgtgggatcaatcggctgatcccagaaggagggggtatattcctccggcagggcgttgcagagcaccacggccgcgtcctggcgggtgaccgccccggtcagcgcggccgcgtcctggccctccagcaggccggcgctccgggcggcatccagccccgcctgatcccaggccgcgccggaagcggcgctgcgggcatattcctccggggcaaaggcccgggcggccatggccaggaactggggccaggtcaggggtgcggaggggctcatggtgttggctccggtgccctggaggatgccatagcccgcggcctccgtcatgtcgatataggcccagtgactggagggcaggtcggagaaggatgcggccgctgcccccgcgggggcggccatgggcagggccagcaggcccgtcaggaccagtgtgcagactctctttaccgtgtgcatgctctatctctcctttacaagcaacggattccgcggcccggccgcagcacctgttttcctccctaccggacccggtagatgtagcgctccttgcggggggcgggtgcaggggccgtgtccgcccggtagcccaggatacagtggccgatgccctcgtagtcgccctccacgccccactgtcggagcagggccttaccctcctcggagtcaaacacctctttggcccggtgaacccagcaagaggccagccccaccgccttagctgcgttcatcaggttgctcatgacgcagctgccgtcatatacccggttggtgttatccctggccgccagcaccaccagcacggtgggcgcaccgtagaaggggtcggcctccggggtgcccagcactgcggcattcatcttccgcagctgctccaccacagcgggattctgcactgccacgatgatcggggactgctggccccgggccgtgggagcataggtgcccgcctccaatactgcgttcaactcctcgtcggtgatctgctccggccggtagctgcggcagctccggcgctccttcaaaaccttcaacacttcgttcattgccaaattacctgcctttcttatgagagatcggttgtattttaccggaaaatacgataagatacaatcctcagattctcttcccaccagtgttgatgaaaagaaaggcggatgcttgtgcctctgtttcccctcctatggctctttttctgttattccttcctcggctgggtgctggagacggcggtttccgccgtccgccttcaccgctatgtggaccgcagcgtgctgttcggcccgctgtgcgcctgctacggcatcactgccgttctgcttaccgtgggtctgcccgagctgcggggcaactacttcttcctcttcctgggcagcgctatctgctccacggtggtggaatggatcgccggtcacctgctggagaaggccacccacacccgctggtgggactactccaaccggcgcggcaacctggacggctacatctgtgtcggcgccttcctcctgtggggcgtgctgggcctggcggccgtacagtggatcaacccgctgctcctggccctctaccgctggctgcctccgctggtgggggaaatcctgctgtgggtgctgctggccctgctggcggcggacatcgcgggcaccgtgctgaccctctgcggcgtccgcagcagcctgcccccgctggagaacctgaacagccgtctggccgccctctccgtccggcttggggagtggattctccgccgcgccgaggggcgcattcagaaggcccaccccggcgcggtcttttcccgccggcgggaaaggaccactgtcagcccctttgcccggggggccagcttttacagcatcctgctcctgttctttatcggcggagtggccggtgatctggccgaaaccatcttctgccgcctcaaaatgggctggtggatgagccgcagcagcgtggtgtggggccccttcagcatcgtgtggggcctggccctggccgccgccaccctgttcctctacaaataccgggaccgctcggcctcctttttctttgtggcgggcaccctgctgggcggcctgtatgagtacctgtgcagcgtctttaccgagctggtgttcggcaccgtgttctgggactacagcgctattcccttcaacctgggcgggcgcatcaacctgctatactgcttcttctggggcttcgccgcggtggcctggttccgggggctctaccccatcctggcccgctggatcgccaagattccaccgcgccccgggaaagcggtggtctggctgctcatcgccttcatgtccgtcaatatggcggtcagcggcctggccctggcacgctacagcgcccgggccgccggagagcccgccgacgcggcctgggaacagtacatggacgcccactacggtgacgacgtgatggagcgcatctacccctatgcgaagatgactggctgagtccaagccgtcaagcaccctccgggtcatgagacccggagggtgcctttacatggggcggagagagccgcgtgggagggcgtcggctctgccccgccggggcccacatctttattttatctgtccggcggaactgaattccgccggcatcaaggttttgggcccacggcccaaaacgcttggacggcgcaaagcgccgccccgccgtcggcggggcccccgaagaggccgccatataaaacgggccccggacgttttcgtccggggcccttgtgcgagcttgtttacttgtagagctccaccagtctggtgagatgctcatagcgctccttggcggcctcttcgttctgggcaaacagctccttggcgcgctcggggaaggcgcgggtcagggaggagtagcgggcctcgttcatcaggaactcctgatagccgccggcgggggccttggagtccagggtgaacgggttcttgccctcggccttcagagcggggttgaaccggaacaggttccagtagccgcactccacggccttcttcatctcaacctggcagttggccataccgcccttgatggagtgcatctcacagggggcgtagccgatgaccagggaggggccgtggtaggcctcagcctcggtgatggccttcagagtctggttggggttggcgcccatggccacctgggccacgtagacgtagccgtactgcatggcgatctccgcaaggctcttcttgggctggttcttgccggcggcggcaaactgggccacctggccgatattggaggacttggaggcctgtccgccggtgttggaatagacctcggtatcgaagacgaagatgttgacgtcctcgccggaggcgatgacgtgatccaggccgccgtagccgatgtcgtaagcccagccgtcgccgccgaagatccacacggacttcttaaccagatactccttgtccttcagaatctcagcggccagcttgcaggcggggcagtcgcagtagggcttgccctcggccttcagggcctgggcgtgggagacaacctcgccctgcttgtcaccgaaaagctgcttgccggcgtcgctggcggcgaaagcggccagctcgtccacggtcaccaggccatcctccagggcggcgatgtagttcttggtggcctcggcgttggccgcgccgtcctccatggtgtccagccacttctgggcggcgtccttcagctcggcacaggcgttgctctccagcagggcgcgggtcttgtcggccaggcggctgcggatggccttctggcccaggtgcaggcccaggccgtgctcggcgttatcctcgaacagggagttggcccaggcgggacccttgccctccttgttgacggtgtagggagaggtggcagccgggccgccccagatggaggaacagccggtggcgttggaaatatacatacggtcgccgcagacctgggtgaccaggcgggcataggcggtctcggcgcagccggcgcaggagccggagaactccaggaggggctgcttgaactggctgcccttgacggtattggtgtcctccacgtcggccttgggggccaccttggccaccatgtagtcaaagacctcctgctcggcagcctgggactcctggggcttcatggtcagggccttgacggggcaggtgctcacacacacggagcagcccatgcagtccagcggggaaatggcaatggcaaacttgtatacacccttgcccttgccggccttgatgtccacgatcttggcctgagcgggggcgttcttggcctcctcctcggtgagggcatagggccggatggtggcgtgggggcagacataggagcactggttgcactggatgcacttggtctgatcccactcgggcacgctgacggccacgccgcgcttctcataggcggaagcgccctggcagaaggtaccgtcctcgtggccgttggcaaaggcggagacgggcaggctgtcgccatccatgcggcccacgggctccatgatctccttgaccatcttcacggtggcggcgttgccctccacgtgctcggccacggtctcgtccttggcgtccttccaggaggcgggcacctcaaacttgtggaacgcggtggcgcccatgtcgatggccttgtggttcatatccaccacgtcctggcccttcttcaggtaggagtgggtggcggcgtccttcatgtagccgatggcctccgcctcgggcatgaccttggccagcttgaagaaggcggactggaggatggtgttggtgcgcttgcccatgccgatctcgatggccaggtcgatggcgttgatggtgtagacctggatgttgtgctcggcgatgtagcgcttggccacggcgggcatgtggtgatccagctcctcgtcagaccactggcagttgatgaggaacacgccgccgtccttcacgtcgcggaccatggggaagcccttgacgatgtaggcgggcacgtggcaggcgacaaagtcggccttgttgatgtagtagggggcgcggatgggctggtcgccgaagcgcaggtggctgatggttacgccgccggtcttcttggagtcgtactggaagtaggcctgcacgtacttgtcggtgtggtcgccgatgatcttgatggagttcttgttggcgcccacggtgccgtcgccgcccaggccccagaacttgcactcgatggtaccgggggccgcggtgttgggggagggcttctcctccagggaggtgtgggtcacgtcgtccacgatgccgacggtgaactggcgcttgggcgcggacttggtcagctcctcatacacggcgaacacgttgctgggcggggtgtccttggagcccaggccgtagcggccgccgatgatggtggcctgccggccggcgttggcgaaggcggtgaccacgtccaggtacagggggtcacccagggcgccgggctccttggtgcggtcgagcacggcgatcttggtggcggtggcggggatggccgccagcagcttgtcggcgcggaagggccggtacagacggaccttcaccaggcccaccttctcgccgtgggcgttcaggtagtcgatgacctcctcggccacgtcgcagatggagcccatggcgatgataacccggtcggcgtcgggtgcgccataatagttgaagagctggtagttggtgcccagcttggcgttgaccttgcccatgtactcctccacgatctcggggagggcgtcatagtacttgttggcggcctcgcggtgctggaagaagatgtcgccgttctcgtgggagccgcgcatcacggggcgctcggggttgagggcgcgcttgcggaaggcctccacggcgtccatgtccaccatgtcggccagatcctcgttgtcccagatggcaatcttctggatctcgtgggaggtgcggaagccgtcaaagaagttgataaaggggacgcggcccttgatggctgccaggtgggccacggcgcccaggtccatgacctcctgggggttggactcgcacagcatggcaaagccggtctggcggcaggccatgacgtcggaatggtcgccgaagatgttcagcgcgtgggtggccacggtacgggcggacacgtgaaacacggtgggcatcagctcaccggccagcttgtacatgttgggaatcatcagcagcaggccctgggaggcggtgtaggtggtggtcagagcgcccgcggccagagagccgtggaccgtaccggcggcaccggcctcggactgcatctcgatgacattgacggtggtgccgaagatgttcttgcggccctgggcggcccactggtccacattgtcggccatggggctggacggggtgatggggtagatgcccgccacctcggtgaaggcgtaggacacgtgcgctgccgccgtgttgccgtccatggttttcagctttctcgccatagaaacgattcctccttgttcatggttccagggcaatgggaatccgtccccgtccatcccccggactgaccgggcccgattcccattaccctggctgattacagctgcctccgggcggagcctgtccccccggggcgcatacattttatcaccttcattgacgtttgtaaatcaaatcttactctgaattattatttttctttttgttcctgaattagaagaaataattggattttttccgttctcctttgagaaaaattatttagttatatataactaactaaactgagcatgctaaaatatgcagttttaaaagcagtcctttgccgtatcatgttctcccctttccctccgccggtacagggccgcttttcaccctttcggcggcgggtccggtatgctataatggatgcaacatgacgaaagggaaaggaggcggcacccatgctctgtgaagtgcgctccctggggctgagcgggatctccggctatgaggtgcgggcagagtgcgacctgtcggccggtctgcccgcctttgagatcgtgggcctgcctgacgcggcggtgaaggaggcccgggaccgggtgcgcgccgccattaaaaactgcggcttcaccttcccggtgtcccgcatcacggtcaacctggctcccgccaaccagcgcaaggggggcacggtgtacgatttgcccattctggcgggtattctggccgccgggggacagctcaggctggacgggccggacagcgcctacgtgggggagctgtctttgtccggctccctgcggccggtggtgggcatgctgcccatggccctggccgcccggagggcgggcatcaagcggctgtacgtccccgccccctccgccgccgaggccactctggccggcgggctggaggtctacccggtggagagcgtggggcagttggcggcccatctgaggggggaggcccctctggagccggcggcggcctggacgccggggccggaggactttgcctgccccgactttgccgacgtgaaggggcaggaaaacgtgaagcgcgccctggagatcgccgccgccggcggccacaacctctgcatggtgggcccgcccggatcgggcaagtccatgctggcccgccgcctgccctccatcctccctgatctgacccgccgggaggccctggaggccacggagatccactccgtcctgggcctcaccacctctgagcaccccctgctggtgcggcggcccttccgctccccccaccacacggtgtccgccatgggcatggccggaggcggctccagtccccggccgggagagatctccctggcccacaacggggtgctctttctggacgagctgcccgagttctccaaggaggccctggagaccctgcgccagcctctggaggacgggcgggtgcagatcagccgggtgtcgggcacggcggtgttccccgcccgcttcatgctggtgtgcgccatgaatccctgcaagtgcggctggtacggctattcggaccgctgccgctgctcgccccaggcggtggagaagtacctcagccgcctgtccgggcccctgctggaccgcatcgacctgttcgtggaggtgccgccactggactttgacgcgctctcccgccggaccccggcggagccctccgccgccatcaaggcccgggtggacggggcccgggcggtgcaggccgcccgcttcggccccggcggcccggcctgcaacgaccagatgggcccggcggagctctcccgcttctgcgccctggacgacgcctgccgcgccgtgatgaagggggccttcgaccggatgggcctcaccgcccgcagctacgaccgcatcctccgtgtggcccgcaccatcgccgatctggacggggcgggggccgtcgccgtggagcacctggccgaagccctccagtaccgcccgccggagtacctgcggcggtaggcccccggacgcgggtggagacaggcccgcccctctggacaacaaaaagcaaattggatataatagtgaaactttgggaaaggaatccagactacatgaacgagattattctgttaaaactaggggagctggtgcttaaggggctcaaccggcgtacctttgaggaccgtctcgtggccaacgcccgccgccgcctccaggcccacggcaaattcaaggtatacaccaagcagtctaccatgtatgtggagccgcagagcgaggactgcgatctggacggcgcgtgggaggccatgaccaagctcttcggcgtggtggggctcagccgggcccgggcctgcgcgaaggacaaggacgccatgctccagaccgccgtggagtacctgggggaccggctggcggccgccaagaccttcaaggtggagtccaagcgggcggacaagaacttccccatgacctccatccagctctcccagtacgtgggcggcgagctggacgagaagtaccccaacctgaccgtggacgtgcaccacccggagctgaccgtctacctggaggtgcgggactacgccgcctacgtccacgccgatccggagccgggagccggcggcctgcccgtgggcgtgggaggccgggcggtgagcctgctctccggcggcatcgactcgccggtggcctcctggatgatcgccaagcggggcattgccctggaaatggtgcacttcttctcctacccctacacctccgaggaggccaagcagaaggtgctcaccctggccaagctgctcaccccctggtgcggacggctcaccgtccacgtggtgcccttcaccgccatccaggaggagctgcgccgcaagtgcccggaggagctgttcaccgtgctcatgcggcggttcatgatgcgcatcgccgaggcggtggcccagcggtgcggcgccggggccatcgtcaccggcgagtgcctgggccaggtggccagccagaccatggaggccatgcgggccaccaccaccgtcaccaccctgcccatcctgcggccggtggtgggcatggacaaggaggagattgtccgcatcgcccggaggatcaacaccttcgagacctccatcctgccctatgaggactgctgcaccgtctttaccccccgccacccccggctgcgccctgtgctgggggagctggaggccgccgaggccgcgctggacgtggagggcctggtaaaggccgccgtggacggcatcgagcgggttcaggtctgaccgcagcggcgggaaacggcgggcggccataaaggccgcccctacggtttctccccccgcggaggagaactcccaattactacatcctcgggcggagtgaatccgccctgtggaaatgctgcgctgcgcatttgcggcggcacccgccgccgatgccggtgttggcgacaggaggtcttttttatgtctcacactgcggagctgatcgcagtcggtacggagctgctgctgggcaacatcgccaacaccgacgcccagatgctttcccagggcctgtcggccctgggcatcaacgtctactaccacacggtggtgggcgacaacccccagcggctgcgggccgcggtggagctggccaaaagccgggcggacattcttattaccaccggcggcctgggccccacctgcgacgatctgaccaaaaacgtgctggccgagtgcttcggcaaaaagctggtgttccacgcgccctccgcccgccgcatcgaggcctactttgagcggctccacgccggccgccccatgacggagaacaactaccagcaggccatgctgcccgaggggtgcacggttctggacaacgactggggcaccgcccccggcgtggccttcgaggcggacggggtgcgggtcatcatgctccccggcccgccccgggagtgcagggccatgttcacccaccgggtgatcccctacctgaagagcctggccgacggggtcattgtctcccggacgctcaagctcttcggcatcggggagtcctccatggaggcccagctccgggaggagatggaggccatgaccaaccccaccctggccccctatgccaaggagggggagtgtgagctgcgcatcaccgccaaagcggcggacgaggaggctgcccgggccctgatcgccccggtggaggagcgcctgcgggcccggttcggccccctcatctacggcgccgacgtaccctccctggaggcggcggtgttccagcttctgaaggaaaagggcctcaccctgggctgcgccgagagctgcaccggcgggctgatcgccaagcgcatgaccgatttgtccggggtatccgccgtgttccgcggcggcgtggtaagctacgccaccgaggtgaagcacaccgtcctgggggtggatcaggcgctgctggacgagttcggggcggtgagcgagccggtggcccgcgccatggccgagggagcccggcgggtactggggtgcgatctggcggtggcctccaccggcgtggccgggcccgatcccgacgagcggggcaacccggtgggactggtctacctggccctggccgcgccggacggcacctgggtgcggaaaatccagcagggtctgggccgggagcgggtacgccacgtgtccgcctcccacggctttgacctggcccggcggtatctctccggcctggaggtaaaataaaaacagcgggtattctgccagagacagaatacccgctgtttttgtataggggcggacaattgccatccataggggccgggcggccacaagggccgctcctacgccggtgctgaaacggcccgcctctagcccttcagggtgacagccacggcgtatgcccgatcgtactggttgagattggccaagtcggagaacccgccgggcaggggaggaattcccacgccctccccgtcatcatagatctccagatagagcggcgtgcgctcccctatggtcatggcccgatcttcctccagccagaccgaggcccggcctgtctccaggccgcggtccatcccgtccagccggggggcgtagctgtattgggtgccaccgtcctggacatttacggtgatcttatccccgctgaggacgacccccagccgccgcgtcccggcggcgctgatggacacgcccccctccgccacggtctgccaggccccgtcctcccaggacagtacctccacggtgcagtcgctcacaccctcgccggccgcgcactcaaacaggccatactccgcgtcggagccccccaccagcttcagcagggccgcctcctcctcggtgagctccagggggcggatggtgttgtcccccagctcctcccccttgtctccgccccgggcgccgcagcccgtcaggagcagggcgcacgccagggccaaaccaagtagctttttcatgtccatcgtcctctctttctctctcatacaatccaggccgagcccaccacggcgtcgccgtcgtagaacaccgccagctgaccgggggttggggcgcgggcgggggtgtgcatccgcagcagcacgccgtcaccctccggctccagggtggccgccgtctgcgtgcgggagtggcgcagccgcaccgtcacctccatggggccggtcaggccgtccacggccagccagttgggctccgtcccccgcacctcgtcccggcccaggtcggagccgtcggagagcaccacctcgttggtgtccggccgcagggcggtcacgtagtaccggtggggccccgatacccccaggccccggccctggcccagagtgtagcagtggatgccccggtggcggcccagcacctttccctctttatccacaaagttcccctccggtgtggaaaacccgcgcctctccagccaggcggcgtagtccccgtcggggatgaagcagatctccatggagtccggcttgtccgccaccgggatgccaaagtcccgggccagggcgcgcacctgggtcttttcgtaatctcccagcggaaatattactttctgtaattgttcccgcgtcagccgggccagcatataggactggtcgttggcgggcatgccctttttcaacaccccgttttccacacgggcgtagtgcccggtggatacataccgggccccgatgcggccggccagggcaaagagcgcggggaacttcaccgccggattgcagcgggcgcagggcaggggggtgcggcccgcccggtagtcggcggcaaagggggcgcacacctcccgctccagctcggcccggatgtcggccgtctcgaagggaatgcccagccgctccgccacggcggcggcgtccgccgcccccgtaccgcccaggccgatgtccagatagaggccggtgacgtcgtaccgctcctgcaagagccgggccgccacggcggaatccaccccaccggacaggcccagcacaatcttttccttcatagcgtctccttttcctgggattttgcggggcaggggcccgccccctctccgccctggggccgctccagatggatcatgagcgcggcgatgtccgccggggagacgcccgagatgcgggaggcctgccccagattgagggggcggatcttgtccagcttctgccgggcctcggtgcgcaggccccgcagggacaggtagtccagatcgggggggaggggccggctctccatcttccgctgctcggccacctggcgaagctggcggtcgatgtagccctggtacttcacggcgatctccaccgcctcggtgacggcggtgggcagcggccgccggtccgggtccgccccggccagactctcataggtgttctccggccggcggagcaggtcgcacaggcggccctccgcggtgccggtgtgctccaggcgcttgatctcccggtccacggcggcgtacttgtccaccacccgccggtaccgctcgccgctgatcaggccaatggcgtgccccaccgggcacagccgccggtcggcgttgtcctgccggtggagcaggcggtactcggtgcgggaggtcatcatgcggtagggctcgttggtgcccttggtcaccagatcgtcgatgagcaccccgatgtacccctggtcccgccgcagaaggaggggctcccggttcagaagcttcagggcggcattcaccccggccacgaagccctggacggcggcctcctcgtagccggaggagccgttgaactgcccggccccatagaggcccgccacccgcttgtgctccagggtggggagcagctcggtgggatccacgcagtcgtactcgatggcgtaggccgggcgggtcatctcggcccgctccaggccgggaatggtgtggagcatctgcacctgcacgtcctccggcagggaggaggacaggccctggatgtagagctcttcggtgttcagccccatgggctccacaaagagctggtgccgctccttgtcggcaaagcgcaccaccttgtcctcgatggaggggcagtaccggggcccgatgccctcgatcaccccggagaacaggggggagcggttcaggttggcccggataacggcgtgggtggcggcgttggtgtaggtcagccagcacaccgcctgattctctggcggccgctccgtctcgaaggagaaggggaggacccgctcgtcccccggctgtacctccatctgggagaaatccacgctgcgggcgttcacccgggggggcgtacccgtcttgaaccgccgcaggcccaggcccagccttttcaggctctcggtcagggggagggcggcggccaggccgtcggggccggaggagcgggtcacatcccccacgatggtgcggccccccaggtaggtacccgaggccaccaccaccgcccgcacccggtacaccgccccgtatgcggtgcgcacggcggtgacccggccgccttcggcatagatatcggtgatctccgcctgcttcacccacaggcgctcctgctgttccagggtgtgcttcatgatctcctggtacctccgccggtcggcctgcgcccggagggaccacaccgccgggcccttgccccggttgagcagccggtactggatgcacgcccggtcggcggcccttgccatctctccccccagggcgtccagctcccgcaccaggtggcccttgcccgtgccgccgatggccgggttacacggcatgttgcccaccgcgtccagattgacggtgaagcacagggtgttcagccccagccgcgccgcggccagggctgcctcaatgcccgcgtggcccgcgccgatgacggcaatatcgtaacttcctgcttcgtaatccatgtatgttccttctcgcttcaaagtatccaacgggccaggcagcggaaaaaccgccaaattcggctcagcgggccgatgtaggcatcggcccctacattttgcgggaaatacttcccttgccgcagacctgcaggggcggggcttgtccccgcccgcggcagccgcactccgccagagtccccagcccggtcgggcggccacaagggccgcccctacatttttgcactaactctttcatcaacgcagacccataggggcgggtgcctgcacccgcccgcagcccccgcactccgccagagtccccggcccagccgggcgtccacaagggccgcccctacttgccgtagacgatggtcaccgctttctggcggttgacgatctcggcgacggcgggtgtgccgccgaactcgccgtccagagtccagggcagctcctggccgcaggcgacccggaggcggctggtgcggaagctggtcaccagcccgccctcgtcgggggacatggtgagcagcgccttgatcaccgcctggagctggaggggattctggggctggcgcaccagcaccacctcaaagagcccgtcgtctaggcggacgggctcggcgggcatgcccttaaagccccccacggacacggtgttgctcaccatgccgtagcagaagccgccctcctccacgccgccatcgtgctccacggtgagggggtaggcctggatggatcccaggcgggtggccccctccagcacgtaggccaggtggccgaagatatttttcaccggctggggcgtgctgtaagccacgtcggtaaaggccccgaaggcggccacatagatgaaatagcggtcgttgaaggagccgatgtccaccggcctgggcacaccggcggcggccaccctggccatggcctccatcccccgtgggagggagaggtttttggcgaagtcgttggttgtaccggcggggatgtagcccacctccggccggttctcccggcccatcagcccggccaccacctcgtggagggtgccgtcgccgccggagcagacgatgcggtcaaactccccggcccgggcggcggccaccgccgtggcgtccccggccccccgggtcgggtggatcgtcacgtcccagtccgccgccagcgcgtcctgcaccgcggccagcctgcttttcagcaggcccttgcccgcgtgggtattgtagagaaagagcagctttttcatgggtgtcctccatctgtttgtgcatccattataccggattgtgggcaaaaaacaacctccgctgtggacggaagcgccaaaaatccgccatccctcttgcttttccatgctaaagtgtgtaaaatagagactccactgtttggcaaaaggggtgtatcgtatggaccgcaaagcgctctccgcggcattcccggtgacggtgccggtgctgatgggctacctggccatcggcatcgccttcgggctgatgctccaggagattggatacaacttcatctgggctttcttcatgagcctgaccatctacgccgggtcgggtcagtacctgggggtgaccctgctgggcgccgccgccgccctgagtacggtggcggtcatgacgctgctcatcaacttccggcacttggtatacggtctgtccatgctggagaagttccggggcatggggccccgcaagctctatatgattttttcccttaccgacgagacctatgccctgctgtcctcagcccgggccccggtgggggtggacccccggaatttctattttgccatcgccctgctggaccagagctactggattctgggctcggtcatcggcgcagtggccggggcgctgatccccttcagcaccgagggggtggacttcgccatgaccgccctgttcgtggtcatcgccgtggaccagtggaggagctaccggaagcacctgcccgccgttctgggggccggggtgacggtgctgtttctgattgtcctgggccacttcttcggccaggatcagatgctgctcatctcgctgggcgtgattgtgctgtgcctgctggtcctgcgggacaggctggacgagaaggaggaagagacatgctgagcaccgcaggggccgtcgccgccatcgcggtcatggccattatcacctttctgacccgcgccctgcccttccttctctttgaccggggggagtcgccccccaagctggtcctctacctgggccgggttttgccaccggccatcatcgccatgctcatcgtctactgtctccggggcgtgtcctttgccgcccccggcggctgggtgccccagctcgtgtccgtggcgacggtggtgatccttcacctgtggcgcagcaataccctgctgagcatcttcggaggcaccattttgtatatggtgctcgtccaggccgtgtttccctaacgcaagcgcccgcccccaaaagggggcgggcgcttttgcccggttcagcgggtgcgcaggcacatcacccgttcgccgtgggtgtcccgctcgccggtaaagcggaagccgaaggactcgtacagcgccgcagccggccggttggcctccaccacgctgaggtagatccgctttttgtggtactcccgctccagccgctccagcagggcggccagcgcggcccggccgtacccccggccctgaaagcggcggtcgatcagcagccggtccagccacagccgtccaaagggcaggtactcccagaaaaagccgtacatggcgaagcctatgagggcatccccatcatagacccccacgggccgccagcaccgccgccggtccgcctcggccaggcactccgccacgctctccacaaagccctcctgtccgggggccgtctccagccgctccacagcggccctggaagccacggtcaccggctccaaccggattttcatcgtctcacgctccatatacgcgaaaacacaggcccgccgcctttcgcgggcctgtgccttcgtaattgaaagaagagaggaaagagagggggcgtggtcatctctgaccacgctgttatcctattccatccctgtgaaccccttttgaaccggatatgaatattttgtaaaggaatgacccgcttactccgccagcagttcggccacggcggtcagatagttgggctctagctcctcaatccggcccgcgtcgcaggcggcggccacggccggatcaatgggcaggcgggccagcaccttcaggcccagatcggcggccacccgctcgatgtggctctcgccgaagatggcgtgctccttgccgcagtcggggcagcggaagtagctgtagttctccaccaggcccagaacggggatgtgcatcatctcggccatcttgacggccttggtgacgatcatgctcaccaggtcctggggggtggtgaccaccacgatgccgtccaccggcagggactggaacaccgtcaggggcacgtcgccggttccggggggcatatccacaaacaggtagtccacgtcgccccagatgacgtcggtccagaactgcttcaccgccccggcgatcaccgggccgcgccataccaccgggtcggtctcgttctcggtgagcaggttgaggctcatgatctcaatgccggttttggtctccgccgggtagatacccagctcgctgccctcggccttggtgtggacgccgaaggcggcggggatggaggggccggtgatgtcggcgtccaggacgcccaccgtcttgcccatgcggcgcatggccaccgccagagaggaggtgaccaggctcttgcccacgccgcccttgccgctgaccacggcgatgaccttcccgatgtgggacaggccgttggccggggcgcggaagtcctggggcgcggtgcgctccccgcagctctcgccgcaggaggagcagtcgtgcgtacaatcggacatgattttcgttccttctttcctatgtgattaacagggttttgggcgggacatacggacggcggactgggacacggccgcgatatatcgcggccctgccccgccgcgccgcccatacaatccgcagggcccgcggccgcctgacgggcgcacacgcaggtgcgcccctacgggtggccttctgatacggcacagagggcggcctgtgtgccgccccgccggtcagtagtggtagcgccccccgccgatgaactcccgcagcagggagtcgggggccaccagggcgggatccaccggctcaaaataccggaaggcgtccaccagatcgtggtactcctgccagcgctcgttgtcggggggcacctgctccaccgccgcccgcagggcgtcggcgtaatgggcaaagaccggcacctcatagcgcagggaggagtcgatgatcacatgggcgcggcccttgtagggcgagatatactttttctccccccggcggacattataccacatcagcagcgtttccaacaggtctgtcccgcggaaattgtagtcccgcacggcgcggcgggagatgcgcatccaggtgcccttgaagcgcagctgctccccctccaggatgttggagcgggcggagatatacatgcccgtggcctccgggtggcggccggcaatgtcgtcgttgagggcgtgaatgccctcgaagatggcaatctcgtccttccccagccgcaggggggtgccccggctgtcgttgcgcatctggcgggcgaactcgaagtgggggacgatgacctcctccccccgggacagccggtcaaaggtctcgtccagcagctccatgtccagcagtttcggggactcgtagtcgatgtccccctccggcgtgcggggggcggtcctgcggttgagggtcttgaagtagttgtccatggacaccgtgtgggcgttgaccccccggcgctccagctcccgctccaccttcatggccgtggtggtcttgcccgagccggaggggccggacagaagcacgatggggctctccttcatccgcgccaggatcttgtccacggcggcgtggatgcgctcctggtagtgggcgtcacactcggccagaaaggcggccgggtcccgccggattttttcgttgatctcactgagctgatagggcatgtcttccctcctttaccttccgtgcgcggcgtaaaattgggccaccctgcccttgtccgcgcagatagcgtcgatcttctggatgtactcctgggggtatttggcgttggccaggcgctcgatgtacccggtggcgcggtcgaccagcttggtcactccgccgccccccagggagacgatggtgtgcagctcctccatcatgcagatgttgtagaggctctcggcgccgggccggcaccagcccacgttctcaaaggagccggacatgtacttctggcggtagaggtaatagggcctctgcccggccccccgcagggcggcccaggcgaaatccagcatatccgccaccgccgcgccggagggcaggccgcccccctcctccatcagccgggagccctttttcagggccaaagtgtgcaccgtcacgttctccggccccaggtccagcacctgctccagggaggcgcggaagccctccgcgctgtcgccgggcagcccggcgatgagatccatgttgatgcagccgatgccgctctcccgggccagggcgtaggcccggagaatgtcgtccgcccggtgggcccggcccatccgctccagcaccgcgtcctgcatggtctggggattcaccgacacccgcgagcacccccggcgggccagtaccgccagcttctccgccgtgatggtgtccggccgcccggcctccaccgtgtactcggtgcagcccgacaggtcgatgtggtccgccagctcccccatgagccggtcgagctggggggcggagagggtggtgggggtgccgccgccgaagtagacggtgcgcacccgcagccccgcgtccgccagcatggcccccgtggcggccagctcccggcacagggcgtccaggaaggggtcaatgagcttgagggcccgccccacgtcggcagagacgaaggagcagtaggcgcaccgggtggggcagaaggggatgcccacgtagagggagacctcaccgggggccaggctgcgcagggccgccaggctggccccggcgcagtccatggccagccgccgccgtccctccgtcacccgataggtgtcccgcagcagccgctccgcctgggccgggccggccccggccagcatggccttggtggggatcttcaccggccgcaccccggtcagcgccccccaggggggctcgccgccccgggcggcggtgcccgcgtcgtagaaggccagcttcaaaatccgctggagcgcccggtcggtggacagcgggtcggtcagctccgccgtccggcatcggcgggcggcccggtattcccgtcccccatagctcagcgccgccgtggcggtggcccagaccgccccccggtgcagggagagcaccagcgcgtcctcccccggcgccgggggcccggcgggatactccggccgctgggcggggaacagcgtcagcagcatttgctcggcggcatatttgtagtcgtgtccgtataagtacagcttcatggccgcctcccttccccatgctgctgacgctcccgcgcccaatggcgcggagccgggcgggattcacttccgcccggcgatacataaaaatcagacggggcccccgcaggagcaccgctcccgtggggaaccagcagcatctgctcggcggcgtatttgtagtcgtgtccgtgtaaatacagcttcatgggccgtgtcctttctccggggggcggcggccttccgccttatccctccatggcctcccgcaggtagtagttggtcttgcgctcctgctccagggtggaggcccccatgtggccgggaagcacgtggtagtcgccggagaggcggcccagccgccccagggaggccatgatctccgcgtaggagccgccctcgaagtcggtgcggcccatggagccctggaacagggtgtcgccggtgagaagcacgtcccccaccttcagcgtcaccccgccgggggtgtggccgggggtgtggagcacctcaatatccatcttccccagcttcaccacgtccccgtcctgatagggcgtcgtctccgcgccgacggcggggagcacgtcgccccccaccagggccgcgtcggccgggtggagatacaccggcaccccaggcagggcggcgcacagctcggccacgccgccggtgtggtcgaagtgggcgtgggtcagcaggatgagcttgagctccatcccgtccgccttcagttgggccaggatacgcgccccctccccgccgggatccaccacggcggcggtgcgggtctcctcgtcctccagcaaatagcagttggtgcccagctggcccacctgcatcactttgatctgcatcctttttcacctcatcaatggttgtctgtgcctgcgcctccgtgggcggccacaagggccgcccctaccgggcggaatgcctcctgatatgacatcgtattcggcggaattcgtaggggcggcccttgtggccgcccgcaaacgccggggcgcgttcggccctacatctggtcggtgtccagcagaatggtcactggcccgtcgttctgtgaatacacctgcatatccgcgccgaacaccccacggggctcccgccccgcggggaccccggttcccttttatctgccggggcggagtgaatccgccccggcatcgaggttttggcggagccaaaacgctcggacgcgccaggggcgcgggggcgagttcggccctacatctggtcggtgtccagcagaatggtcaccggcccgtcgttctgcgagtacacctgcatatccgcgccgaacgccccacggggctcccgccccgcggggaccccggttccctttttatctgccggggcggagtgaatccgccccggcatcgaggttttggcggagccaaaacgctcggacgcgccgggggcgcgggggcgagttcggccctacatctggtcggtgtccagcagaatcgtcaccggcccgtcgttctgcgaatacacctgcatatccgccccgaacgccccacggggctcccaccccgcggggaccccggttccctttatctgccggggcggagtgaatccgccccggcatcgaggttttggctccgccaaaacgctcggacgcgccgggggcgcgggggcgagttcggccctacatctggtcggtgtccagcagaatggtcaccggtccgtcgttctgcgagtacacctgcatgtctgcgccgaactcgccgtgctccacccggaaaccccgcccggcgcactcggccataaatttctcatagagggggatggccaccggcggcttggcggccccggtgaagccggggcggcgggacttggtatcggcatagagggtgaactggctcaccaccagcagcgcgccccccaccgcctccaggttcaggttcatcttctcgttctcgtcctcaaaaatccgcaggccgcacaccttgtcggccagcttcaccgcctgggcctcggtgtcgctggggcccacccccagcagcaccagcagcccctggccgatctcgccgttcacccggccgtcaatggtgacggaggcactcttcactctggtaacaactgcgcgcatcgctcaaattcccttctctttgtttgttgcaggggccggcaccccagggcggccgggctaccggtactcccgcacaaacccccgtgcgtacagggggtcgatgtcgaacaccgccggatcgccggcggagcacttgaggtcggtgacgtccaccacggtctcaatggcgccgatggcccccaggatgcgggcccgctggccgttgacgcggacggtgcgccgccgggcggccagccagcgccgcagcagggcgcccaggccgccgccctgggcgcgggccacgccgaagccgttctgatagcccacgggcagcaccgccacgcgggtgggccgccggaggacgacggggcgggcgctgcccaccgtgtgtcccttggggagccagcgggtctcctcgatgcccacctcgccgtagcccacccggtacagtccgtcgccgtggacgcggcggcagcggcccagcagggcggagcccgcccgcaccccgtccagccgggcgtcggcgcagtggagcagggcgtaggacccggcggcgtggacaacccccgtctcaaagcccgcggcccggatggcctccaccacccggtggaactgccccagccgggcggccagatcctctccgccctttttccgggcgtggagctgggtgcagatgcccgacacggccacattgggcaggttgcggtagaccgagaggatcttctccggctcgtcggccaggaagccgccgaagcccatgccggtgtcgatctggatgtgggcctccaccacggtggagcgggcctccgccgcgccgttgagggccatgcccgtgtccgccgagcccacagtgcacaccacgttcagatcgatgagctgctccagctccgcccggtccacggtggggcggagcatcagaatctcctcctccacaaagcccgccctgcgcagggcggcggcctcggcgggctcgctgacggcgaagcggccgatgccctcctcccgcagcagccgggccagctccaccagcccggccccctggccgtcgccggtgagcaccgcgtagatcacggcctcgcccgcccgctccttaatgacgccgatgttattctttacggcctcccgctcgatgaccagcgttttcatggccccgcctctctctcttgcctggttttttctattatatactcccagaaagtttccgtcaacgaaaaggggtttccgcttgtgtttcgacaggaaaagtgatatgattttgagattgaaatactctttttggaggaaccagcttgaatcgacagaccacccgaatttcccccgcggacgtggaccgccagcgggatttctgccagaagctccacgagcggttcgccgcccggccgtccgcgcccctggcctttgtggacacctacggctgccagcagaacgaggccgactcggagcggctgcggggctacctcagcgagatggggtaccagttcacccagagtgaggcggaggccgacctgattgtcatcaacacctgcgccatccgggagcacgccgagatgcgggtgctgggcaacgtgggcgcgctggtgcacaccaagcgggccaagcccggccagctcatctgcgtgtgcggctgcatggcccaggagccccacatggcgcagaagatcaaggactcctaccggcaggtggatctggtcttcggcccccacgccctgtggcggttcccggagctgctctaccgccttgtgacccgccgggggcgcatcttcgacattgccgacgagcccggctccatcgccgagggcatccccctggtgcgccaggagggggtgaaggcgtgggtgagcatcatgtacggctgcaacaacttctgcacctactgcatcgtgccctacgtccgggggcgggagcgctcccggaagccggagatcatcctggacgaaatccgcggcctggtggccgaggggtacaaggacatcacccttctgggccagaacgtcaactcctacggcaaggatctggacgagcccatggacttcgccgacctgctcaaggccgcctcggagatccccggggacttcctgctccgcttcatgaccagccaccccaaggacgcctcccagaagctcttcgacaccatggcgtcctcccccaagatcgccccctgcttccacctgcccttccaggcggggaacgaccggattctgaaggccatgaaccgggtgtacgaccgggcgggctacctggacaaggtgcgccgcctgcgccaggccatccccgacgtggtgatcacctccgacgtgatcgtgggcttccccggcgagaccgccgaggagttcgaggacaccatgaccctcatcgacgcggtgcgcttcgacgcgctgttcaccttcatcttctccccccgggagggcacccccgccgccaaaatggacgaccccatccccaaggcggagaaggcggcccacttccagcggctggtggagcggcaggaccagatttccgaggaaaagcacgccgcctacatcggaaaaaccgtccgctgcctggtggacgggaaggacgacaagggcctcaccgcccgcacccccggcaaccggctggtgcgcctgaccggggacgagggcctgatcggccagtttgtggacgtgaagatcaccggggccaacaagtggtccctatccggggagccggcctgacccggccagctccagccccaggcccagcccgcagcggaacagcgcccgctcataccggaagtcccgctcggcgcgggccgccgccagacgctccagccgcgccctggcctccggcggcaggttggcctccagccactcctccgcctcgtccatccgccgcccggccagacagtattccgggtcgccgttcagataatacgcaatccggttttcctggatatagttgtagagaacgtctaaaatttgttccatcggatagccccccgatctttgaccgaacggtcaattctatttctattatacattgcccattcggtcaatgtcaaggaggttttatggcaacttttgcagaacggcttttgctcctgcgggaagaaaagcatgtctctcagtccgtggccgcgaatgcctcgggaattaacctccgaacctatcaccgctatgagaatggcgaacgggaggcctccgtcagcacgctgatccgcatggcggattattttggggtaacgatcgactatctggtgggccgcagtgacgcccgataggccggagcggaagaacccccgcctgcgggggtgggactacggcgcgggcggcacctattttgtgacgttctgcacctcagcgcaccgccccgtcctctcctccatccgtaggggcgacccttgtggtcgcccgcccctcgttctcaccccgctgggggagtgcgtggcggaggccatcgcgcttaccggggtacgggtggagcaccaggttatcatgcccaaccatgtccatctgctcctgacgctggaacgggcggccacaagggccgcccctacaggggccgggacgcaggccgctacaaggattgcctccgcagacggccaaacgcgagtagccgcaaggattgtccccacaggagccgggacgcaggcggacgcaagggttgcccccacagacagtgggccgcgggccgccgcagagctgggacggcttgtaggcggcgtgaaatcccggtccgtccatctggccgccgggcggggactggaggtcggccgcctttggcagcggggctactacgaccatattgtccgcagtgaaaacgactttctgcgcatctggacctatattgacaacaaccccctgcgctgggagctggaccgctactacacagagagatagaacaggagagacgctatgccgccagagaccacgcccatgatgcagcaatatctgcgcatgaaggagctgcaccaggactgtattttgtttttccggctgggtgatttttacgagatgttcaacgaggatgccaagctggtatccaaggagctggagctgaccctgaccagccgggaccggggcaagccggaggcgcagcgcacccccatgtgcggcgtgccctaccacagcgccgacgcctacatcgcccggctgatcgccaagggctacaaggtggccatctgcgagcagatggaggaccccgccctggccaaggggctggtggaccgggacatcatccgcatcatcacccccggcacggtgatgacctcctccatgctggaggaggggcgcaacaacttcatctgcgccgtgtaccgggacagcgcgggcacggggctgtgcttctgcgacatctccaccggcgagtgctccgtcacctccttcaccgggccggaggcggacgagcacctctataacgagctgggccgcttcacccctcgggaggccatgctctccgacggggcgtacagcgacggcgccctggtggacttcctggtcaagcgcctggactgccgctgcgagaacgggggcgaggcccgcttccggctggacgcggcccgcacggcggcggagaagcagttctccgccggcctggacgccctgcccgccggggacgacgccgccctccaggcggtgggcggcctgctgtcctatctctacgagacccagaagaccgacctgtcccacctctccaccctgacgtacttcaccaccgggcagttcatggagctggatctcaccgcccggcgcaacctggagctgaccgagacgctgcgctccaaggagaagaaggggagcctgctgtgggtgctggacaagacccgcaccgccatgggccaccggctgatccgggcgtggatggagcggcccctgctctccccggcggccatcggccgccgcctgggggcggtaggggagctggtgggcgacgccatcggccgggaggagctgaccctcaccctgcgggaaattaccgatctggagcggctgatcggccgcatcgtctacggcaccgccggcgggcgggatctggtggccctggcaaacggcctgggcaagctgcccgccctgcgggagcggctggccggctgctcctccgccctgctggcctccctgcgggaggagctggacgatctcaccgagctgcgggagctcatcggccgggccatcgtggacgagccccccttctccgtccgggagggcggcttcatccgggcgggctaccacccggaggtggaccgcctgcgggacattatggccaacggaaagggcctggtggcctccatcgaggccagggagaaggagaagaccggcatcaagagcctgaaggtgggctacaacaaggtcttcggctactacatcgaggtgtccaagtcctattacgaccaggtgcccgacacctacatccgcaagcagaccctcaccaactgcgagcggttcatcacccaggagctcaaggagctggagcacgagatcctctccgcccaggaccgcatcaccgccctggagtttgagctgttctgcgacctgcgggagcaggcggccgcccaggtggggcggattcagcgctccgccgccgccgtggcccaggtggatgtgctctcctccttcgccgccgtggccgccgagcagggctactgccgccccgaggtggatctctccgacgccatcgagatcaccgagggccgccacccggtggtggagaagatgctcaaacacgccctcttcgtccccaacgacacccacatggacaaccgcgacgacacggtggccatcatcaccggccccaacatggcgggcaagtccacctacatgcgccaggtggccctcattgtgctcatggcccagatgggctccttcgtccccgcccgctccgcccgcatcggcatcgtggaccgggtgttcacccgcatcggcgccagcgacgacctctccgccgggcagtccaccttcatggtggagatgaccgaggtggccgagctgctgaaaaacgccaccgccaagagcctgctgatcctggacgagatcggccggggcacctccacctacgacggcatgtccatcgcccgggcagtgctggagttctgcgcggacaagaagcgcctgggggccaagaccctcttcgccacccactaccacgagctgaccgccctggaggggcagatccccggggtgaagaactacaacatcgccgccaaaaagaagaaggacgacatcctcttcctgcgcaagatcgtccggggcggcgccgaccagagctacggcatcgaggtggccaagctggccggagtgcccgagccggtgctccgccgggccaggaagatcctggaggagctggaggcgggcgtacccgccgcccccgccccggcctccgtacagccggaggagcaggtctccctgctggatatgggctcggcccaggtgtccgcccgcctgcgggatgtggacgtgaatgtgctcacccccatcgaggccatgaacctgctctacgagctcaagcagatgctctagtccccgccccggcgggcgggtgtgggcacccgcccctgcgtgtcggcgtttgacgagaggggccgccggtctcccacgcactctgtaggggcggccctcgtggccgcccgcccgaacccggcggcgggacacagatgacgtgggccgtgggcggggacaagccccgcccctacgtgtcagcgtttgacgagaggctccgcccaccggccatgcgccctgtaggggcggccctcgtggccgcccgcccgaacccggcggcgggacaccggaaacgcgggcggggacaagccccgcccctgcacgtcctgatacccgattggactgccccggaggggccgacgccccagggcggtttctcttgcccctctggggcaattcaccttctgcccacatcggcccgctccgccgggccgcaccccaatttccgagagaaagagaggacctccaccatgcacaccaaacgccgtccatggcgtccgcagctcacccgcgccgagatgggccgggggtgggtgttctttgccctgtacctgacggtctttcccctgtccatggggtgggtgcagcgggctttccacggggaactgcccgtggccgaggccaacgtggtctactacctcctggccgctaccctggtctttctggtcttctggacgttcctgcggcacgggtttgacctgctgctggactggctgccggaaaacctgttcgccttcggcaccgggctcgtcggggcgggggtgctccatctgctggtcatgctcattcccctgccggtacagaatcccaacccggagagctacgcccagcagtttgccctctccccggcggccacggtggtgatcctggtggtgctcatgcccctggtggaggagcctctgttccgcggcctgctcttcggcgccacccggcggtacagccgggtgctgggctatgtgctctccaccctggtttttgccctttactgcgtctggcagttcgtctattcctacggcacggtggatttccgctacctgctgctgttcctccagtatgtgcccatgtccctggccctgacctggtgctacgacaacggcggctccatctggagccccatcgccctgcacatggtgctcaacgccctgattctcgcctccgccgtcctgggagcgtagggagggccctccccgccgcccgcgggcggccacaagggtcgcccctacgcttatttccccgcttggaacgcaggcgcttcttcgtcggcacaaacttgcccattcctcgctttgccgtatacggcaaagcccgctcgttccgctgtgcctcctctccccaccgaacccgcttcgctgggcttcggcgggggccccattttccctttttagaaagcaggtgcttctatgccccacattctgcaattagatccccacgtggccgatctgatcgccgccggcgaggtggtggagcggcccgcgtcggtggtcaaggagctcatggagaacgctatcgacgccggggcggacgccctgaccgtggagatccagcacggcggcatgagcctcatccgggttaccgacaacggctgcggcatcgccgccgccgaggcggagaccgcctttctccgccacgccaccagcaaactgcgcaccgagtacgatctggaggccatcggcaccctgggcttccggggggaggctctggcggccatctccgccgtctcccgcatcgagctgctcacccgcacggcggaggaggatttgggggccgccctctccctggaggggggcgcggtggtgcaccgggaagaggccggctgcccccagggcaccacaatggtggtgcgcgacctgttctacaacacccccgcccggctcaagttcctgaaaaaggacgccgccgagggggcggcctgcttcgccatggtgcagcgggtggccctgtcccacccggaggtgagcgtcaagttcctccgggacggcaagcaggagctgctcacccccggcgacgggcaggtgcagtcggccctctacgccgtgctgggccgggatatggccctgggcttcacgccggtgaagggctcgggggaggatatgtcggtgtccggctttgtctccctgcccacctgctgccggggcacccggggctaccagcacttttttgtcaacggccggtatgtgaagagccgcaccatgatggccgccctggaggaggcctacgccaaccagaagatggtgggcaaatttcccggctgcgtcctccacctgaccacccggctcaacgcggtggacgtcaacgtgcaccccaccaagcaggaggtcaagttcggcagcgacaagaaggtctttgacgcggtgtactatgccgttaagtccactctggaggccgaccgcacccggccgtccctccaggtgaagcccccgcgccctgcggagggggggcggcctgcggaggctcccctccgcccggcggagcccgctccggcggcccccacctaccgggagatgaccctggaggagttccgccggacggcggaacggcccgcaacgcccctgcccctccacgacttcaccgccccccgggccacaggggccgccccggcagcccctgccgggaacggcgtctccggcgcccccatctccatcccccagtccgccggggcggacacccatatccgcccggccgaagccgcacctgtccccgccgggagcggcatctccgcccccccaacctccgccgcgccgcacgcgcgaacggacggccgtgcccgcccggctgaatccgcccctgcctccggcgcacccatctccaccgtccggcccgtcggggcggatgcccacatccgcccggctgaagccccgcccgcccatccggtaggggcagcctttccagccgcccgccccgccggcgaaccctctgcgcccccttcggaggaggagccctggcgcatggcgggggaggtgctcaacacctacatcatcgtggagcagggagacaaggtgctcttcatcgacaagcacgccgcccacgagcggctgaacttcgaccggatgaaggccgagggctaccagcccatggtgcaggccctgctggagccggtggtgttcacccctccggcggaggagggggccgccctgctggcccagctcccgctgctggggcgcttcggctttgaggcggaggacttcggcggcggggcgctgatcgtccgggccgcccccagcgacgtggccgccggggagatccccgacgtgctctccgagctggccggccgcctgctcaccggcggttccgccgatcccggcgcggcccgggacgccctgctccacaccatggcctgcaaggcggccatcaagggcggccagaggaacagccccgccgagctactcaaggtggcccaggcggtcatgtccggcgcggtcaaatactgtccccacgggcggccagtggccattgagctgacccgccagcaactggaaaaacgcttcggcagagcctgatttgaccgcgcttcgcgcctttggcgcgtccaagtgttttcgcctccggcgaaaaccttgccgcaggggcaattcacttgccccgaggatgtaaaatcctctcggggcccccggtggacaggtccgccggggagcaaatattgcccccacgggcggccggtggccattgagctgacccgccagcagctagaaaaacgcttcggaagagcctgatttgaccgcgcaccgcccgcagccctatcgctcggccgggcggccacaagggccgcccctacgtggaagccacagtcaaacctagggcaattccggcccaccgcagtccgtggcggccttgcccaggcgggtacagcgcactcgcttccaagtttggcgggggccgtgggggaaaacgccgaagagacacagccccgcgccgtttcgacgaaatccgcccgataattggtatatattggatgcatcttatagatagaaggagtgcatccacatgcaaaagaccaacaacctgcaagacctgtttctgctccgcgcccgcaagtcccacgccagcctgaccgtatttctgatgaatggctatcagctccggggacagatcacgggctacgacgcctttgtggtggtacttatgacgggggacaagcagcaggtcatttacaagcacgccatctccaccattgtgccggagcgggccatctctttggaggcggagggggcggcagactaaggagctgccatgaagcaaggaaccctgatcaaccgaattgtcatgctgctgctgctggcggccgtcctggtgtatctgggcgtgtccgcctggcggagcttccgcgatccctataccctggtgctgtcctacgcctacactgtggacgacagtctggaggccaccggctttctggtgcgggaggagcgcgtgctcgccagtcccggcgggattgtggatctgctgcccgaggagggagagaaggtctcccgcggggagacggtggccctgctctaccagaatgactccggcctggcgcggaaggaggagctacagagcctgaccatggaaaaggagcagctccaatacgccctggagcggacccagagcggcggcgactcctcccagctcagccagcaggtgatcgacgccatcgtggccctgcgctcctcggtgtccaccggggatctcacccagctggaggacgagaccctgctgctcaagagcctggtctacaagcgggactttaccttcaacggcggggaagaggacggcgatgccgccgccgccatccagtcctccattgacgcggtggacgcccagattgcggcgctgagcgcccaggccgcccaggacaccagccgcctcaccgccagtcaggcgggggtcttttccgggcagaccgacggctatgagagcctgctcacccccgctctgctggagaccatcacccccggccagctcagccagctcgaccgccagcggccccagccggacgccggcgcggtgggcaagctggtcaccgatgccacctggtactttgtctgcgccatgggcgaggaggaggccgggcggctcatcgagggccgcaccgtcaccgtccgcttctcccgggactggtcgggcgaggtggacatgaaggtggagcgggtaggggagaccccggagaacggccgggtgaccgtggtgctgtcctccgaccgctatctgtctgagaccaccctgctccgaaagcagacagtggagctggtctttgacagtcagaccggcatccgcgtgcctacgcaggcagtgcgcgtggaggagcggaccgtcaccgacccggagacggaggaggaaaagcaggagctggtcaccggcgtgtacgtcctggtgggccagcaggcagagtttaagcccgtcaccatcctggcccagctggaggatttcgccctggtgaagtccgcagacggctcggacggcaaaaaggccctgcgggccggcgacgaggtaatcctctcctcggtggagctctttgacggaaaagtgatcacgcagtcatagacagggaggtaatgacacatgtcccttgcagagcgcattgcgctggtaaatgagaaaatcgccgccgccgcccggcaggcgggtcgggagccgtcggaggtcaccctggtggcggccaccaaggtgcagacctccgacaccatccggcaggccattgccgccggcgtcaccatctgcggtgaaaaccgggtgcaggagatgaccgcccacctggacgacgacgcctacgccggcgcggccctccacttcatcggccaccttcagaccaacaaggtgcggcaggtagtgggccgggtggagctcattgagtcggtgggctccgagcacctgctggaggccatcgaggcccaggccgccaagctggagctggtacaggacatcctgctggaggtcaacatcggcggggaggcgtccaagagcggcatttccccggaggagctgtccgccctggccgcccaggcggttggcagcccccatgtgcgcctgcgggggctcatggcaatccctcccgtggccgccgggccggacggaaaccgcccgttttttgcaaaaatgcgtcagctttatgttgacataagaagtcagatggatgataataagactagctttgactgtctttccatgggtatgagcggcgactttgaggacgccgtgcgggaaggggccaccctggtccgggtgggtaccgccctgtttgggccccgtcctcccatgcacaaaggatagaacaaattcgggaggttaccgaaatgggatttttagatgaactcaagcgcctggcccgcccctatgaggacgaagaggaagaggaggagtttgacgacttcgagcccgtctcccgcagcgagcgcatggaccgcaccggcggcgaccgcctggagcggaaggcccccaaggcccaggacagcaccggccccatctttcccgtggagaacgagcgccggagcaacaaggtggtcaatatccacaccaccacccagcttcaggtggtgctggtcaagcccgagcgcttcgagaacgccagcgagatcgccgaccacctgcgggagaagcgcacggtggtgctcaacctggagtccaccaacaaggatatcgcccgccgcctgctggatttcctctccggtgtggcctatgccaatgagggcaaaatcaaaaaggtggccatctctacttatattattacgccctacaacgtggatattttaggcgatctgattgacgaactggagaacaacgggctgtatttctgaactgctcttcaggacaggaaaatgtccgggttgtcccgccgggagtccggcgtttcaagcgttttggcaccgccaaaacacggatgccgggcgaatccacattgcccggcagatgccaaagagggggttcccgcccgatgcggagcatcgggtggggaagacatgaacaaatcgggggaatgacgttatgctgacaccacaggaagtttccgagcacgcctttgccaaggcgtccttcggcggctataacatggcgatggtggatgaatttctggacgtactgacggcggactacaccacgctctataaggaaaacgccaccctcaaggccaagatgaaggtactggtggacaaggtggaggagtaccgctccaccgaggaggccatgcgcaaggccctgcttaccgcccagaagatggccgacgagctggtggcccaggcggaggccaagaaggccgagctgctgaagaacgcggagacggaggccaaggcccgtattgcggagctgcagcaggacatccgcagtgagcagatgcgcctcaccgccgcccagaacgccaccgccgcctatgtgggcaagctcaaggagctctatcagcacgagatggactacctcaacggactgtccaagctctccgccccggcggagcctgtagtggaccaggttgcctctgccgcccaggacatctcccagagcgtggagaagctggtggccggtgaggcgccggaggaggacgcggaggacacggtggatctcggcggcggcgccaaggagaaggacggcggcctgtatgccgagctgctggagctgagccgctcccacagtccggaggaggctgacgagcccaccgagcccacccgccgcatcgattttgaccacctccagttcggcaaggactatgaaatcaagtaaacccccttgacagaagggcatttaacgggtaagatactcggagacacgttgtttcgtgtctccgagtatcttttatttcgcaaaacgccgagaagaggacgagtaccgtccccgcccctgcgcagagagccgccgttttggtgcaaggcggacagggaagggctgggaagatcacctccgagcgtcccgccgaatcccccctggggcagtaagcgggaacggctggccccgttaccggccttcgaggggccgcggcacgccgcggcaatgagagtggtaccgcagaggtttgcgcctttgtctcttacaggagacaaaggcgcgttttgtttttgccaatttcggcaagggcgcacgcctttacaccaacctgtttttatatcaaagataaaggagaactgacccatggactacaaccagaccgtccacctgccccagaccgacttccccatgcgggcgggcctgcccaagcgggagccggagatgctccaggagatgtatgaccacgacctctaccacaagatggtgaagcgcaacgagggcaagcccacctttgtcctccacgacggccctccctacgccaacggcaacatccacatcggcaccgccctgaacaagatcctcaaggatatgatcgtcaagcaccgcaacatgaccggctggtgcgccccctatgtacccggctgggacacccacggcctgcccatcgagtccgccgttctgaaggacaagaaggtaaagcgggacgagatgaccaccgcccagttccgcaccaagtgccgggaatacgccgagagctacatcgagaagatgaccggccagttccagcgcctgggcgtgctgggggagtgggagaacccctatatcaccctgctgcccgagtttgaggccaagcagatcgaggtctttggcaagatggcggagaagggcctcatctacaagggcatgaagccggtgtactggtgcccctttgaccagaccgccctggccgaggccgagattgagtacgccgacgatccctgcaccaccatcttcgtcaagttccccgtggccgacgacaagggcaagctgggccagtatgccgacctgtcccgcacctacttcgtgatctggaccaccaccccctggacgatccccggcaactacgccatctgcctcaacgcggagttcgactacgtgctcctccaggtgccctccggcgatgtatacgtgctggcccaggatctggccgagagcgtgtgcaaggccgcgggcattgactacgctgcctgcaccgtgctggccaccctcaagggcagcgcgttcgagctgatgcgcgccaagcaccccctgttcgaccgggagagcgtcatcctcaacggcgagcacgtcaccctggacgccggctccggctgcgtccacaccgcccccggcttcggcgcggaggacttccagatttgccagcagtacgacaaggccggcctgacccacatcggcgtgcccgtgcccgtcaacgccaagggcgtcatgaccgacgagcgctacaacggccagttctacgccaagggcaacgacatggtggtggccgatctggaggccgagggcttcctggtggccaaggagaacatcacccactcctacccccactgctggcggtgcaagcaccccatcatctaccgggccaccgagcagtggttctgctccgtggacgccatcaaggacgcggcggtgaaggcctgcgactccatccagtggaagcccgagtggggcaaggagcgcatgacctccatgatcaccgagcgcaacgactggtgcatcagccgccagcgcgtctggggcgtgcccatccccatcttctactgcgaggactgcggggccgatatcgtcacccccgagaccatcgcccacgtggccgccctcttccgggagcacggctccaacgtctggtttgaccgggaggccgccgagctgctgccccagggcttcgtctgccccaagtgcggcaaggcccacttcaccaaagagaccgacatcatggacgtgtggttcgactccggctccacctgggccgccgtggcggccgagcgcccctacctcaagtaccccgccgacctctatctggagggcggcgaccagtaccgcggctggttccagtcgagcatgctcacctccatcgccgtgaacggcgtggccccctacaagcagatcgccacccacggctggacggtggacggcgagggcaaggccatgcacaagtccctgggcaacgccgtctcccccgacgaggtcatcaaggactacggcgcggacatgctccgcctgtgggtggcctccgccgactacacccaggacatgcgcatctccaaggacatcatgaagcagctctcccaggcctacctgaaaatccgcaacaccgcccgctacatgctgggcaacctgtgcgacttcgagcccgaccgggatctggtgccggcggaaaacctgatggagctggaccgctacgccctgcacaccttcaacgagctggccaaaaccgcccgcgccgcctacgaccgctatgagttccacgccgtctaccgcgccgtctacaacttctgcgtggtggacatgtccaacttctacctggacatcatcaaggaccggctctactgcggcgccgaggccgagcgccgctccgcccagaccgccctgtaccacatcctggacggcatgacccggctcatcgcccccatcctggccttcacctccgacgagatctggcacgccatgaagcacgcccagggcgtaaacgccgagagcgtcctgttcaacgacatgcccggcgacaacgccgcctttgccctggacgcggccgccaaggatcgctgggcgaagctggtcagcctccgcgacgcggtgaacaaggccctggagaatgcccgtaacgccggcgtgctcaagaaggcccaggacaccgacgtgaccctctccgtgtccgagtccgacgccgccttcctggccggggtggatctggcctccctgtgcatcgtctccaaggtcaccgtcaccaccggggccgtggagggggagaagagcgaggactgcctcatcccctgcaccatcgccgtcgccctggacgagtcccccaagtgcccccgctgctggaaccacagcgagcacatcggcgccgacggccaccacaaccagctgtgcgaccgctgcgccgccgtggtgggtgagtaaccccgcagatggaacagacaggacgccgcagcactgcggcgtcctgtttctttcatgcccagagcccgtattttgccgtcccgcaccggcgggccggccggcttgccgccgcgcagactctgtaggggcggcccttgtggccgcccgcgggcgggtgtgggcacccgcccctacaagcctgtattttctcccttcgcgtatagccacccaccagggtggccccgcttgccccttcaaggcaatttatcttctgtccgcatcggccccctgggcggggacaagccccgcccctacgccgcggctgcagggcgcgcccgcgcaaaaggacacgccgcaggctatgcctgcggcgtgtcctcctcttcttccgtttttttcgtcaggctgcggtaggtctcccaatcccgttcggccttctctgtctgctccagaccctcataggcatcggcacggatgtcgtatgccttggcgtaccctggatccagcttgatggccttgttacagcttgtgaccgcctcgctgtatcgctccagcctgttgagaacaattcccacgttcacatgataaagcgccctatctcccgcgagtttgaccgcctttcggtgatcggccagcgccttttctgtctccatctgggacaagtatacaaccccccggttgttataggctcttgcataattagggtcgatctggatggccttttggtagctctgcagggcctcctgcacctctccaagcctttcctgcacatctcccaaggtcgtatagagctccgcatcggccggttccagctccagcgccttctcataatcggcctgggcctttttatactcctccagagcttggtaagcgctgccccgctccctgtaaagcctcttgtcccccggtggcagtttgattgccctggtgaagtcaaggacagctttgtcatacagcttcacagtggtaaagcacaggccccgattgcggtacacctccgaagtctcctttagttccagcgatcggctgtattcccggattgccagctctgtttctcccaaccttctgtagcaaaaccccttataccagtagagcttgctgtcctccattcccaactctttggctttcgtgaagtcctccagcgcctgggcatagtcgttggcaaaatagtagagctttccccgctcccagtaggcctccccgtcctcctcgtccagctcgatgcggcggtccagccgctgaagctcctcccgctgtttggcgtccatggcccggaggatggcgctctgggtctcgctgggggtctccgcggcccgcagcttctcctgaaattccttgacctgctcctgatagtccctcacccgctgctcggccgcgctttcgatgtgctcgcagggatcagtatagccgaaccgctgccccatcaggtacatcatctcgtcaaagccctcaatggggataaagtatccgccgtggcgctccaccaccttctgaatctcctccggcggctcgtcgtggcggtagcaccagtagaggccgctcaggcactcggtctccttcagaaagtccatcaggctgtggtcgcccccggcatagccgatcaccacgggggtataacgcttgaaggcctcccgcaggatatccttccactgcttcgacaggccgttgacctgctcggcccggttgagggggtcaaagaacaggccccggtggagcttggcgatgatgggccggctggtgttgaagttgatgtactgggccagcagctcatggctgatgacgatgggccttttatccgtgtagataaacagggcgtcctccaccaggctgtcgaaattggtggtgatcaccaggttgttgcgcgtgttggccagcagggcggccaggggatagtagcccaggctgggctgggcgcgctccagcgtccgctccaggaaagcggagccgttctgatagtccggaaaaaagcgcatggcatagaggtcaaaataggcccggctggacggcttggtcgagcgcacccccagccgctttttcagctccttgatctcctccttggagcattgctccaaaatctccccgtgccactgtttggccagttcctccccggtggggataccagaggtcttggaggccccggcgcccaggatgaagcagtagcgccgctcgtttttacagccctcctcaagggtattcaggaacacatttaacgaaagggtccgcctttcatccaacgcactcaccacctttcggctttttgccccagtataccagatttttcttgtttcttcaattggaatctacatccgatcttccgggttgcccccggcggcaggccgtgataaaatagaacaaaaccgaagaaaaggagccctttgcccatgttatacgccgttctcgtggtggccctggtggtactggaccaggtggtcaagttcctggtgcgggccaacatccccctggggggagacgtcccctttctcccccatattctccatctcacctatgtgcagaacaccggcgcggccttctccctgctggaggagcacacctggattctgaccattgtgtccctggtggtgtccgtcctgctggtggtgcttctggtgaaaaaggtctttccccgccccttcgccatggccgccctgtccatggtgctggccggggcggtgggcaacctgatcgaccgggccctgctgggctacgtcaccgacatgtttgagaccctgttcatgcgctttgccgtcttcaacgtggcggacatctgcgtggtggtgggtggcatcgcgttctgcgtgtactacctcttcttccacggcaaggaggagggccatggagccgattctgctgcgggctgaccgggcgggggagcgggccgaccagctcctggcccggctggtgccggagctgacccgctcggcggcccagcgcctgctggaggagggggcggtcaccctcggcggccgcccggtgaaaaagaactataaggccgccgagggcgacgtgctggaggtgcgcctcccggagccggagccggtggacgtgctcccccaggccatccccctggacgtggcgtatgaggacgccgacgtgattgtggtcaacaagccggtgggcctggtggttcacccggcggcgggccatccggacggcacacttgtcaacgctctgttatatcactgtggtgaatcactctccggaatcaacggagccctccgccccggcatcgtccaccgcatcgaccgggacacatcggggctgctcattgccgccaagaacgactatgcccaccaggccctggccacccagctccaggatcactccctttaccgggagtacgaggcggtgtgcgtgggcggcctgcgggaggacggcggcactgtggacgcgcccatcggccgccaccccaccgaccggaagaagatgtgcgtggattggaaaaacggccgtccggcggtgacccactggacggtgttggagcgcttccccggctatacccatattcagtgccgtctggagaccggccgcacccaccagatccgggtgcatctggcctccatcggccaccccctgctgggggacgtggtatacggggccaagaagcccgtccccggcctggcgggccagtgccttcacgccagaaggctctcctttgtccacccccgcaccggggagcgggtcaccgtggagtgccccctgcctgcctattttacccaagtgttgacaaagctgcgccatttggtataaactctaaaataaccgtagaacaaatcgaatcgcaggggtgctggacgcaagtccggctgagatcagggcgtatggccgcccgtgtcccttaaacctgatccgggtaatgccggcgtaggaagagtattcgacgatagaggtcgtttctcccgtaccgcattgcgctgtttccggtttgcgctgcggtacattttttaggaggaatgagctctatgtctgaacctgtcaccacaaaagcccctggccgccgccgtatgtatctgctggtgcggatgctttgcgaaggcggactcatgatcgcccttgccctggtgctggggcttctcaaggtatttgagctgccccagggcggctccatctcgctggagatgctccccctgctgttcttctgcgtgcgctggggcatgggaggcggcttcatcgcctgctttgccttcggcgtactccaggtattcatccagggcgcggtaagctggggctggcagtccatcctgctggattatgtgctggccttcggtgttatgggcatcgccggcctgggccgtggcaagccccacggcatcttctggggcagcgtgctgggcggagccgcccgctttgttgtccactatatcagcggtatcaccatttacaaaattctggcccccacggagatcttcggcacagtattcgacaatcccgccctctactcccttatctacaacggcagctatgtcgggattgaccttgtcctgtgtctggtgatttttggcattctctatgcaccgctgaaaacgtatatgacgggggccgatctgagaaggtaaggtgtgaatcagttgggcaaattcaacggcgtgctgctggtcagcgattttgacgacactctctacggggaggacatgcgcatcacccgggaaaatgtggaggccctgacctactttacccgggaggggggcaccttcactgtggccaccggccgcgcccgccccaacttcgccccccacgccagccacatacccatcaacgcgccggtgattctgtccaacggctccgccctgtacgacttccggacaggggagatgatttacgagacctttctgcccgaccgggtgcgggaggatctccagcaaatggcccgggccattcccaccatcggctttgaggcctaccaccacgacgccatctacgtctaccagcccaacgccgtcacccaacgccacctggagcgggcaggcattaccgcccgggaggtgcccattgcggatatccccctgccctggagcaaggtcattctccagcaggactatgaaaccctcctgcacacccagcgctacctgctggagcggtggggagagcattacgaggtgatcttctccaaccgggtgctgctggagctgacccggaaggggagcagcaagggcggcatggtgcagtacctggcccgccgcctgggcatcgacgcccagcacatctactgcgtgggggacaaccagaacgacatccccatgctggccgtctccgccatccccttcgcccccgccaactgcgcccccgaggtcaagcagtggggcgcccgtatcctgggcgcctgcgaggagagctgcgtggcgcagattgtggatatcctggatcatatttacgcgtaaacatgtgcgccgcccgccggaactccggcgggcggcgcgtactttcttgcttgtaccctgttgtattgcgtggacggccgcccgtctaaagggcctccatcgccccggccagcagcagggcgtaatcgggcagcccgtccaggggtgcccgctcatccaccgagtgggcgtccagaatgtccggcccggcggaggccatgaccagccccggggccttggcccggaacaccgacggctccagccccacgtggacggcggagagctccagcgtccggccggtctgctcccgccacacccggcccagcaccgccgccagggggttggcccggtcgccgggccagccggggtagccggtgacggacagggagaacccgtgggccgcccccagggccatgtgccggccagccagctccgcctcccactccggccgggcggagcgcaggaaggcgcacacctcataaacatccccctcggtcccggcccggcccaggttggcggaggcccccaccgtaccggggaaggccggctccatggcgtacaccccgtggtacagccccatcaaaaaggccaggacgtgggcctggaaggccggcgtccacgcccgctccggcctctccgccggggcgcaggccacggtcaggccgggatcggccgcccggtagtcggccagggcgccccgcaggggggagaggtcgggctccgcggggcagaataccactgcctcggcctgggcggggatggcgttgtgggtcaggcccccggagagggaggcgatccgcccgccgggcagcccggccagataggcggccagcagcttgatcgggttggcccggccccggttgatgtcgtcgccggagtggccgccccggccgccggagagggtgagcctccaggcggggagcgccggggccggcccggcgtccagcggggcggcccaggtctcccgccttccgctggccgagcccaccaccgcccggcccaggtgaaagccgtcggtgttgagcaggtattccgccccggccagccagtcgggcgccacctccttggccccctccagccccacctcctcggcggtggtgaagagcaggcgcaggggcccgtggttcaccgccccggtggacaggagccacagcgccgccgcgttgcccaggtggttgtccgcccccagggaggagcggccgtccgagcggaggaagcccccctcctccaccaccgtcaccgggtcggtgagggggttccagccgttgcccggccggacggcgcacaccatgtccaggtggccctggaggatcaggcggggggcgcgtccccggcccggcgcggggggcacgtcggccatccggttgcccgccccgtcccggacgggggagaggcccagcccccgcaggtatgcgtccagctcctccccggcggcctcctcgtgccgggaggggcgggggcggcgggagaggatgcggaaggtgtgtacgatgccccgggtgatggcctcccggccccccaggcgctccaaaagcgtcatatgcaatcccttctttcgggggtattctaccacatctccgcccgccgcgccaggactaggccttgtttgaaaaatagcaatatggccagcggcgaggaattttacccgctggcaagcaattttttcgcaggaatcctggcggatttcaaggaaaaattgggccgtccagagggcaaacggcccggcgattgggcgtgttgactattttcaaacaaggcctagcccaccgcctcccagatgcccagcagcaccagcagcgcgccggagagggggagggcgtatttgcccagcagccgcccggccagcttatcccccagggcgcggcccagggggagggcggccagggtgaccaggaaattcgccagggccgcccagccgggggcgataccggacaccccggcggccacgccgatgcccgcgttgttcaccgccagggcggcggccagggagacgcacccccagagggtggcggcccggttttccccttccgcctccccggcgggtcccaggcggcgcagccagtccagcacgaaccacgccccgatgcccaccagcaccagcccgcccagcaggttgggcagcggcccgctgagcacccgggcggccccggcccccaggagcagggaggcccaggtgatcagggtggtgagggcggcgataatcaggctgtgggacagggagacccgcacgcccttcaccgcgtagcccatcgagagaattacagtatccagattacaggccgcggcaaacaggaccgcggccagaagcagcgaaagccattccatagcactcctcctattccgtccatcctatgccgggtgtgaaacaggggtgccgagggtggcttttcaccggaatttatgctatactggattttactatctgtgaaacggaaagggagactgccccatgagcgccaaggaagaatttatcgagatctaccgggagaacatccggcgggacggggcggatgccctgctggactacctggagcacaaaagcgattttttcaccgccccggcctcggcccggttccacggggcctacgcgggcggcctgtgtgagcacagcgtcaatgtctaccactgcctgaccgcctacctggagcgggagcgggtgagggagctgtacggcctggagtacccggcggagagcgccgcgctggtttcactgctccacgacgtgtgcaagacgggctgctacagggagggctcccgcaacgtgaagggccccgacggcaagtggcaggcggtgcccacctttttctacgaggaccccctgccctacggccacggggagaagagcgtctacatcctctccggcttcctgcgcctcacccgggaggaggccatggccatccgctggcatatgggcttctccggcgacgaggacaagcggctggtgggccaggccctccagcagtatcccctggccttcgccctcagcgtggccgacatggaggccacctatttcctggaaaaggaggagagctgatccatggcaaagcgcgaaaacgacctgggccgcgatcccatcggcaagctcctcctgcggctggcggtgcccaccgtcaccgcccagttggtcaacgccctctacaacatcgtggaccgcatctacatcgggcacatccccggtgagggcgatctcgccctcaccggcctgggcatctgctttcccgtgattctgtttgtctccgccatctccgccctggtgggcatggggggcggctcccgggcggtggtgcgcatgggggaggggaagctggacgaggccaacaaaattctgggcaactgcaccctgctgctgatgatcctgggcctggccgccaccgtggtattccagctctgcaaggagcccatgctctacctcttcggcgccacggagaacaccatcagttactccatggactatttgaatatctacctctacggctccatttttgtggagctggccctgggcctgaacttctttatcacctcccagggcttctccaccgtcggtatggcctcggtgattatcggcgcggtggtcaatatcgtcctcgaccccatccttatcttcggtctgaatatgggcgtaaagggcgcggccctggccaccatcaccgcccaggccgtctccgccgtgtgggtggtgcgctttttgtgcggcaggcgcaccaagctgcggattcagcggcggcttctccgtctggacggcaaggtgctggccccggtgctggccctggggctctcacccttcattatgcagtccaccgagagtctggtcaacatcgccttcaattcctccctcaagacctacggaggcgacccggcggtgggcgccatgaccatctgctccagtatcatgcaggtcttttcccttctgtttcagggcctgtcccagggggcccagcccattgtgggctataattacggcgccgggcagttggaccgggtcaagcggacctttcgcctgctctttttctcctccctgtgctttagttgcgccgcctgcgcggcgctggagctctttccgggcctgtttgtctcgctgtttaacgacaagccggagctggtggagatcgccgtctgggcgctgcacatctatgccgccggtatgttcatgctgggggtgcagttctcctgccagcagaccttcgtggcgctgggccagacccgcgtctccctctttctggccctgctgcgtaaggtgatcctgctgattcccctgatcctgctcctgccccgcttcctcagcgaccaggttttcgccgtgtttctggccgagccggtggccgatatcctggccgccaccaccaccggcgctatcttcttctggcgcctcccccgcattctcgaaaagcggcgcctggagctggagcacaggcccatctaaccccaaaaaggggggcgttccctacgggaacgcccccctttttatggctccaggcccagcagctccagaacaacaacctccagcgcccgggccaggtggaccagctcatagtccgccaccacccgctccccggtctccatccggctgatggccttttgtgtcagccccagcccgtccagttggagccggactgcgagctgctcctggctcagccccgcccggtctgtagatcttcaagctccgcaccccgtttattccaaagataggtaacctcagttgacagtatcacgggggctctgcgatgattattccaaacatgactaagcaaagtaaaaaatttgatttttcctcataagaagagctcccgccctcttgtcaccgcaaaaaaagcgtgctatagtggctctaccgataaaaggaggaatggaatcatgcacacacttcccaagcgcgccctggctgtcgcctgtgcggcagccctgttgggtaccggcacctccgccctggccgcggagtccgtccccgcctccgccccatccaccgccatctccgtccaactggacggccggaatctgtccttccctgacgccgcacctgaggcgagggacggccgcaccttcctgcctgtgcgcaccgtgtttgaggccatgggggccgaggtgagctattcccccgccgctcagaccattaccgcctttcgggacggcaccaccgtcaccatggctctgggcggcacaacagccaccgtggagcgcagcggcgtcaccacccacatccccatggacgcggccccctacgcccacgacaaccgcacctatgtgcccgtacgcttcgccgctcaggcctttggttgcgccgtgggctgggacgccggcgaccgcaccgtgatcctcattgacatggaaaagctggtggaggagaccctatccaagtatgactttacctatctggaaaaatacctggcatacggccagaagtaccgcacgggaatccgggacatgaacgccgactttgacgcctctctggacatgacgggccttcttctgggaagtacggcggaatctgcgcccattaccctggacggcactctggagggcgtcatggccggcggcgcgaagatggacgccgctatgggcctgactatggatctgcgccccttcctgaaggctctgacggatggccagaacggaggtatgagcgccagcgataccgagttgttggatgcccttgccgaggaaggtatccatatggagctccggggcgatctggagtccggacagctctatatcagcctgggcggagcatttttggagcaggccgccggcctgcccgccgacacctggtactccatggatatgagtgccatatatgaggacatggggttggactacggtgccctcatggagatgatcaccggcgacgtggactataccgccctgctgtccctgcttctctccaccgtggagcccaatgacaaggacaccgcctattccgagctgacccaggccgtagatttggccgcccagctcctgcgggacgacgcctgggcggtcagcgggaacgaccgcatccttcactacgccctggagcaggacggcgtggccgccgacttcaccttcaccctcaccatgcggggagatgacgtatccgcctatgacctgtccgtagagctctccgccgatgtcgacggttccgctcccatgtccatctccctccaggagtccatggacgccgacggcaggatggaggcctctatgcagtgtgatgccgccggtctgatggacttggaattctccatgtccggccggtacaccgagggcaagaccgcccctgaaaccgagcctcccaagggggccgtggtggtggatctgaccgcccccgaggcccccgccgacccggttcccacctctggggatccagccgaggtggtcattgataagatttacaccaccggcggcggctttatcggcgtcacagagggctgattccagagcaggggctctccgggtaagccggagtgcccctgctctctccccggcggggtgctgattttacctgatgttctgtgcatttttcacgaaaatcctcttgactttcccctcccatactcgcatgatatagatggattttacccgtccggcctccctgcacaccggacgggaccaaacaaaggagtgtgagtatgatgcaagaaaccatgctgcaggaagtgatgacggcccccagggagatccggtttgacagggtgcccgttcccacggccgggcccgggcaggtgctggtgaaaatcaagcgcatcggcatctgcggctccgacatccacgtataccacggcaagcacccctacaccaagtacccggtcacccagggccacgaggtctccggccaggtcgcggcgctgggggagggagtcacccaattccaggtgggtcagcgggtgaccattgaaccccaggtgtactgcggcgaatgctacccctgcacccacggcaagtataacctctgcgagaacctgaaggttatgggctttcagaccaccggaactgccagtgaatacttcgcggtggacgcctcaaaggtgacggcgctgcctgcgggaatgagctatgacgagggcgccatgctggagcctctggccgtcacggtgcacgccgccaggcgggcgggggacgtagcgggcaagaaggtatgcgtgctgggctgcggccctatcggcattctgctggttcaatccctgaaggcctttggcgcggccgaggtcatggccaccgatatctccgactatcggctggagctggcccgcacctgcggagcggattacgctgtcaacaccaaaacccgcccctttggcgcggctctgacggagtgcttcggccccgacaaggcggacatcatctacgactgcgcgggcaatgacaccaccatggatcaggccatccagaacgcccggaagggaagcgttatcatcttggttgcggtgtacgctggcctggcccactgtgatctggccaagctcaacgactccgaactggatctgaacaccaccatgatgtatcgccacgaggactatgtggatgccatccgctttgtacgcgagggcatggtacagctccaacccctgatgagcaggcattttgcctttaccgactatctggccgcttacgagtacatcgatacgcaccaggaaaccaccatgaaggtcctcatcgacgtggaccccagcgacgactgaggaggggagcgccgtgagcattgcagagcatgtaaccggcctacagcacctggggcttcccaccgccgcgctggacgagaccgccgctttttatgagtcccttggctttgtccgggcccacagcactgtcaatcccggcacgggggagcgggtgtgctttctcacctgcggcggcctgtgcatcgaaacctacgagtgcgccgcgcccgcccgccggcccggagccatcgaccacctggccctggacgtggacgacattgagtccgcctgggaggaagtgcggatggccggcctggccccgttggaagatgccattcagttcctccccttctgggagaacggcgtgcgctttttcaacctactgggccccaacggagagacggtggagttcagccagaggctgtaggccgcgcagcgtctggctgcgactggtcagttcggcgatatctgactcatttctttgtgcaaaattagagaatttgcctgacccccttgccaaggggcccctttatagactataatgtatatatgttacaacaatccaatctagttaaagcaatgactgtaaaaagagaggaagggatcgtgccatgctggaagacaagagactggataaggatgtgcctattcccctgtatttccagcttgaaaagctgatcctggaggagatcgacaacggaaattacccggtggggagcatgattcccaccgaaatggagctcagccagatgttcggcatcagccgtaccaccgtgcgccaggccatctccgacctggtgcgggaggagcacctgtaccgcatcaagagcaagggcacctttgtggcccaccccaagctggtacagggcttcattcagagcatccagtcctttgacgacgacgtacgcagcaccggccgtacccccagcaccgaggtactggatctcaagctggtggagctggagcccgaggtggcgcagcttatggagctgcccgcgggcaccaaggccatctatctctaccgcaagcggtttgccgacgacgagcccatcgtccgggtggagacctacctgccctatgaagcgtgcagctttatcctgggacacgactttaaccgggagtccctctatcaggtgctgtccaagcgggacgacacccgggtaacccacgtcacccgtatctgcgaggcccgggccgccgacccggaggacgccgcggttttgggcttgaagcggggccgcccggttcactatttccagaccatcggctataaccagagcggcaagctgattgacctctcctttgcccactaccggggcgaccagagccggttccgtgtcgagctgttccgcgagtgagtgcacgcgcggaatttgcttccccttttatgtagtaacatagttacaatcctacgatactttatcaggaggtcaggtcatgttccatgtgcaaaccgtcagcggccccatcgcaccggacgcgctggggcacagccagatccatgaacacatctttgtccaccggacgcccatggcggagaaaaatcccgccctccggctggacgacccggctcgttcactggaggagctgcgcgcctaccgggcggcggggggaggcttcctggcggacgcccagcccgtggccgcaggacgggatgcagagcgcctcggcgcgctgtcgcgggagagcggcgtggcggtggcggcctctaccggctaccatcttctgggcttttacccggcggactgctgggtccacagcctggatgaggagggcctgtacgacctctactgcggtgagctgctggagggcatgctcccctggcggcccgagccggaccgccgcccggcgcagccgacggcctttcgggcgggcctggtaaaggccgccattccggccgaaggcgccgagggccggtacgccgttttgctgcgggcggccgcccgggcggcggtgcgctgcggggtgccgctgatgctccacacggagcggggggagaataccctgcccgccctggagctctgctttcgggcgggcctgacgccggaacggctcatcgtctgccacgtggaccggcaggccgacgacttcggcccccatgacgccatcgccgccaccggcgtgtacctggactacgacaccatcggccgcttcaagtaccactccgacgaggaggaggtggcgctgctgcggcacatgtgtgagcgggggtacacccagaggctgctcctgtctctggacaccaccgcccagcgcatggccgcctacggcggcgagatcagcctgtgctacctgctggagcgctttctgccccggctggaggcggccggcttcccccccggaacccttgcggatttcaccgtgctcaattgccggcggctcttcgccggctgaccggtatttcaataccaaatcagtcaagaaaggatgcgcctgaccatgatcaaactccccgaacccgccaaacggcccaccatgtactttgtgggcgtcaccaccggacagtcctccatcatgaaaatgttccccatctgggccaaggagctggggctggacgcggagatcaagggcatcgacctgcccatccacgcccccgccgaggactaccgggcggtggtgcagttcttccgggatgaccccctgtccctgggcgcgctggtgaccacacacaaaattgacatgtataacgccgcaaaggatatgttcgactacctggacccctatgcccagcgcttcggggagctgtcctccatctccaagctggacggccagctccgcgcccacgccaaggaccccatctcctccggcctggccctggacgccttcgtgcccgagggccactggcttaagaccggcgcggaggtgtgcatcatcggcgccggcggctccgccctgtccatctccgcctacctgggcaatgaggagcggcacggcaaggatctgcccagccgcatccacctgaacaaccgctccgccccccgcctggccgaaggcgtgcgcatcctggagtacctgaacgtccccatgagctaccatctgtgcaagacccccgagctcaacgacaggattgtagaggccctgcccgccggctccctggtcatcaacgccaccgggctgggcaaggaccggcccggctcccccctcaccgaccactgcaaattccccgagaacggcctggtgtgggagctcaactaccgaggcaccctggagttcatgcaccaggcggaggcccagcgggagcgccgggggcttctgattgaggacggctggacatactttatccatggctggacccaggtgatcgccgaggtcttccacatcgacatcaccggagagcggctggccgcctgcgaccggctggcccgggaaatgagaaagtgacgccaaggggagggctctgtcatgaaggtacttaccacaccccgttcttacgggaaaaccgatcccgaggtctttgccatgctccgggccgccggcctggaggtggtgcgcaatgagacgggcgggatcctggacaaggagggcatgaaggccctgctggccgactgcgacggcgtgatcgtgggagtggatcccatagacgccgaggtgatcgccgccgcccctaagctcaaggccatcgccaaatacggcgtgggggtggacaacattgatctggacgccgccaaggcccgggatatcaaggtctcccgcacggtgggcgccaacgctgaggcggtggcggactacgccatggccctgctcctggcggtggcccgcaagacggtgctcattgaccagcactgccgccagggcgactggaagaagatcaccacccgggacgtgaccggcggcaccatcggcatcctgggcctgggggccatcggccgcaacgtggcccagcgggcccagggcttcggcatgaaggtgctggcccacgaccccttctgggacgaggcgtacgccaaggcccacggcatcacccgcgccgcccccgacgagattttcgccgagtgcgacgtcatctccctccacctgcccctgacgccggagacggagaacttcatcggcgcggcggagctggccaaaatgaagccggacgccatcctgatcaacaccgcccggggcggcctcattgatgaaaacgccctgctggacgcgctggaggcgggccgcctctgcggcgcgggcatcgatgccttctcctccgagccgcccaaggatccccgctggtttaccctggacaacgtggtgctcggctcccactgcgccgcctccacggcgggcgcgtcccgcaacatggggcgcatggctactgccaacctcatccacgatctgggcctgtagggcgggaggacagcgatgaaatacatactggcccacgatctgggcacctccggcaacaaggcaaccctgttcagcgacgaggggaaaatgatcaccagcgaggtgttccgctacgactgccactacttcaacaccaactgggccgagcaggatcccgaggatttctggaaggccatctgcgtcaccagccgcaacctgattgacaaggcccgcatcgaccccggcgacatcgccgcagtctccttctccggccagatgatggggtgcctgtgcgtggataagcagggcaaccccctgcggccctccatcatctgggccgaccagcgggcccaggcccaggccgccgccctgggggagcagatctccctgcgggacttctaccacatcgccgggcaccgcaacagcgcctcctacggcctgcaaaagctcatgtgggtgcgggacaacgagccgggggtgtatgccaagacctacaaggccctcaacgccaaagacttcattgtcctgcgcctgacggggaagttttataccgagccctccgacgccacctccaacgcctgcattgatctgaacaccctccagtggtcggacaagatcgtcaacgcctcgggcatcgacggcgacaagctgcctgagatcgtcccctccaccaccgtggccggggaggtcaccccctgggccgccgggcagaccggcctgaaggcgggcacgccggtggtcatgggcggcggcgacggcctgtgctccaacgtgggcgccggctccatcagcccgggccgcaccttcagctgcatcggcacctccgcctgggtggccaccaccagcgagaagcccctctttgacgaggagatgcgcaccttcacctgggcccacatcgtccccgggctgtactcgcccaccggcaccatgcaggccggcggcagttcctacaactggctcaagggccaggtggccaaatatgagaccgccgtggccaaagtgcagggcatcagcccctacgatctcatcaacgcggaggcggcaaagagccccgctggcgccaacggcgtcctcttcctgccctatctgctgggggagcgggccccccgctggaacccggacgccaccgccgcctggctggggctgaaaatggagaaccagcgctgcgacctcttccgggccgtactggagggggtcaccctcaacctgaacattattctggagtccttccgtaagagcatccccatcgacgagctgctggtggtgggcggcggcgcaaagggcgccctctggtgccagatgatggccgacgtctacaacgcccgcatcaaggtgcccgtcctgctggaggaggccacctccatgggcgccgcggtcaccggcggcgtgggcgtgggggtgttcaagggctttgaggtcatcgaccagatgctcgagctcaaccgcacggtggagcccgaccccgaggccgtggccgcctacggcccggtgaaggaggcctttgaggtgtgctacaaggccatgctgcccgtctacgagtacatggcgtcccacaagaatgcgtaaggaggtttttcccatgaaaaaggaacaggtacttgccaggcttcgctcctgcggcctggtggccgtggtccgcgccaaggacgccggcgacgccatgcgcatcgccgaggcctgcatcgagggcggctgcgccggcattgagctgacctacaccacccccggcgtcaacgccatcattgagaagatggccagagagtatgacggcaccgactttgtcatcggcgcgggcactgtcatggaccccgagaccgcccgcatggccatcctctccggcgcccagtatgtggtcagcccctacttcaacggcgacaccgtccgcctgtgcaaccgctaccgcgtggcctgcatgcccggcgccatgagcatcgccgaggtggtggccggcatggaggcgggtgcggacatcatcaaggtgttccccggcgagctgttcgggccgaagattctcaagtccatccacggccccatcccccaggccgagctgatgcccaccggcggcgtgtctctggacaacgtggccgagtggattgcggccggcgcggtggccgtgggcgcgggcggcagcctgaccgccggggccaagaccggcgactacggcaagattaccgagaccgcccgccagtttgtggagaagattcgcgctgcccggggccagtgaggcgcgccatgaacccgattggaatgcactacggcttctggagccacaactgggacgagattgcatacatacccctgatggagaagctggcctggctgggctttgacatctgcgaggtggcctccgccgagtggggctattacgacgacgccaggctgcgggagctgaaggcctgcgccgatcacaacggcctgggcatcacctattccatcggcctggaggccaaatacgacctggccagcgacgatccggcggtgcgggagaacggcatccgccatgtcacccgcatcctggagagcatgcccaaggtgggggcggccatcctcaacggcgtgtcctacgccgggtggcaggccctgcccgaccacggaatcaccctggacgagaagcgccgcaaggaggagcttgccctggagtccatgtcccggctcatgaaggtggcggaggactgcggcgtgctctactgctgcgaggtggtcaaccgcttcgagcagtacctgctcaacaccgccaaagagggcgtggagtttgtcaagcgcctgggcagtcccaacgcccgggtgctgctggataccttccacatgaacatcgaggaggacagcatggtggacgccattctggaggcgggcccctggctggggcatttccacgtgggggagaacaaccgccgccccgccggctccaccaaccgcctgccctggaaggacatggccgccgccctcaagcaggtgaactaccagggggccattgtgatggagcccttcgtgctcatggggggtaccattccctatgatatcaaggtctggcgggatctcagcggcggggccggggaggccgggctggacgagatggcgggccgggcctgccggttcctcaaggagctgaccgcgtaaaaggaggcaatgcgctttatgcaaacatccaagctgttcaccctgctgccggaggagctggtgtgcacccccgacggcatggccatcgacagggacggcaacctgattctgtcctgtcccaactttgcggatctgtccatgcccagctgcgtgctgaaaatcgacaaggaccgcaacatcaagaagtggtttgacgtgccgcgcaacgagtacaccggtgaggcccgggccatgggcatcgagttcggccccgacggcgacctctatctggtggacaacgcgggctggaccggagagccccacatggtgttcaccgggcgcatcctccgcctgcggctcaacgacgcgggggtggtgaagtgcaccgtggtggctgacaacatggagcaccccaacggcatccgcatctggggggactacatgtacgtcacccagagctgcatgacccgccagaagacggacagcggcaagctcatgagctgtgtctaccgcttccccctggacgccgagggcatccactgcaccaacaccctggccgatccccacatcttcctcacctttatcaccgagaaccccaagtgccagtacggcgtggacggcatcgtgttcgaccacgacggcaacctctacgtcggcaacttcggcgacggggtggtgcacaaaatcaccttcaaccccgacggctcggtgaaggagaaccgcaagtgggcctgtgatccggccaacctgaagtccaccgacggcatgaccatcgatccctacggcaacatctacgtggccgacttctcggccaacgccatcgcccgcatcacccccgacggccgggtgacgcggatggcctgctcccccgacaccgacggcttccacggcgagctggacgagccgggcgagccgtgcgtctggggggacaagatcatcgtctcctgcttcgatctggtcaccgacgaggagaaggtcaataccgcccacgaaatgcccgccaccatggcgatgctggacgtggagccctagcgagaaacataaaagcccgcccaccccaagccggggcgggcgggcttttttcggcacacggagaggaggcgctctcaggggtgaatgataaccttgcgggcctgcttctggacgatgtagtccaggcccttgccgtagtcctccagcggcagctcgtgggagatcaactccttgacctgcaccgcgccgctctccagatactccagcgcccggccaaagcagtgggtctgggcgaaggagccgaggatggtgtactcctggctgaaaatgtcgtaggggctgacgggtaccttggcgtcggcggcgcagacgccgtaggccacaatcttgctgcccatgtggacaaagtggaagcaggactcgaacaccgaggcggccccggtggcgtcgatgacaatgtcgaagcccttgggcatgatggccttgatctcggcggtgtgcttggacgggtcggccttgtccatgaccaccaggtcggtaaagccgtacttgcgcagaatgtccagcttgtcggcgtggggatcggcgatgaccatgcggcccgcccccgcccggcggagcagctgggccaggatgatgccggtggggcctgcgccgaacatgaggatggagtcgccgaagcggggggcgatgcggtccacgccgtggaccgcgcaggcggtgggctcggtaaaggtggcctcctcaaaggacagcttgtcgctgagggcgaacaccttgtcgtagttgatgagcacatactcggcaaagccgccgggcatgttgcagccgtgggagttgaagttctcgcagtacaggggcttgtcgctgcggcacggctcgcagtagccgcacagctcagtgttgtcggcggtgacccggtcgcccaccttccactcggtgacggcgctgcccaccgagtcgatcacgccggcgaactcgtggccgttcaccagggggaacttggccagaaagcttccgtcgtggatggtcaggtcggtcttgcagatgccgcaggccttgacccggatgaccacctggtgggggccgggctccggcttgggcagatctaccacggcaaactgccggggggcggtgtattgaatggctttcatgcgtgcgcttcctttccgtccggccgcggcccgcttacaggcccttgcggcgcttgcccagggtgttggccatcatgatgccgtcaaagaccatctgcgggttgacggcgaagggctccacgtcccagtaggagtgcatggaggtctcggccaccttcctgatgtcggcctcggtggcgtcgggaatgcccagatcgtcaaaggtggtgggcaggcccacttcctcgaagaaggtgtacagctcgtcaagctcctcggcgggggcgccctccacgatgagctgcaccaggatgccgaaggccaccacttcgccgtgcagcagcttggcgcagggctccaggacggtgatgccctcggcgatggagtgagcgcccgcgcaggagccgttctgcacgcccaggccggacagcagggtgttggcctcgatgacgtcctccacgtccttggtgcacaggccctgctcggcggccagcttggcgctgacgcccttggtcaggatggtctcgtggcacgccttggacacggcgatgcaggcgatggtctggtgatagccgctgttgacgtagttgggggaggcggactgcacgttggcccggcactccgggtaggtggacagggcgtcgcccatgccggccaccaggaagcggatgggcgccttggccagaatgtcggtgtccagcagcaccagatcggggttcttcttgtagtggcgggcgcccacgtgctcgcccgcggcggtgtagatgacggacaggcccatggcgggagcgtcggtggaggcggtggtggggacgatgatcaccgccgcgttgtagttgtcggccacagccttggcggtgtccatggtcttgccgccgccgatgcccaccaccacgtcggggttcagggccttggccaggccggtgcagcggaggatctcctcctcggtgcactggccgccgaactgctcgcactggatctggctgtcgctgccggcgtacagggcctcgaagcgcttcttgtagtcggcgaagaagaacacgtcaatgaggaagaacaccctgcggccgtagacctcggtgtgggttttcatgttctccagctcatagcggccctggatgtagcggctgggggagccccaggcgcgggtggaatgctgcagcatggacatggaaatgacctccttattatgtaaacaaaaatcggattggtttagttgccgtccagcagggcgggcagctcgtacaggctgttcagccgccaccgggccggggacagatcctgcgcccccgagtcggggttgtataccgccgcgcaggccagacccgccgccacggcggagcggacgccgctgccgctgtcctccacggccaacaccgcgccgggcggggcaggacgaaagacccgggccgccgcctgataaggggcgggggctggcttgaggggcaggccgtcgctgccggtgacgatcaccgcggcgtcctcgtacatccccagctcccgcaggcagcgctccacataccagcgccacgaggaggacaccaccccaaaggggataccccggcggcgcagggcgtccagggcctcctccaggccgggcatcggccccacccggtactcctccagcagctggcagaccagccggaagtgccgctgggacagctcctccgccgaggccggcccgccgaagcgggccaccagagcctcgtagagctggaggttggacttgccggcaatctccccggcgtccgggggcgcgcccccggacaggctgcgggccagctgcgcataggccatgcggtggtatggctcggtgttgcgcaggacgccgtccagatcaaacaggacggccgcgaagggcggggctacaccttccatttggggttgtcgataacggcgggccctccgtcccgctccaccaccagcttccggtagcccttctcctcgatggtgccgtagtcgtggccggcgtccccccggtagacgaagaacatcaccagaggctcggtgccggtgttgatgctgcggtgggcccagcgtccggggacgtagagggcctcgccggggccgatctccttccagtccacctggccctcgggggtctccatcagcatcatgccgtggccgctgaggccgtagtagatctcggaggtgtccaggatggtgtgaaagtggcccttggtcatgaaatactcctcccccacctttccggggtagaggatggtggtgccgaactggagcacgccggagtcgtcttcgggcagatccaggccgtagaactcatacagcagggggtcgcccccctccaccatggcccgggccgccgcctcattggcaaactgggcgaccatgtcggacactctgcgctgggtgggcttgaccttgccgctcgtgcagaagccgcttacaaggtcaaagtccagcacaaacggttttacatcggacataagaggcactccttctttcttacttgacgatctggccgcggatgctgcggtccaccgtaagggcgatggccgccaacacaaagataccaaagacaatgttctgatagtaggcgttgacaccgataaagttcatgccgttttcaatgatggccacggtaaacacgcccaggatggtgcccagctcgctgcccttgccgccggccagcgaggtgccgcccagggcgcaggccgccacaatctttagggtaaaggggtcgccgatggtgggggcgctggagcggaggttggccgccaggaagataccggccagagcggccagcacgccgttgatggcaaataccagaatcttggtcctatccacgcccataccggccacccgggcagtgcgctcgttgccgccgatggcaaaaatggtccgtccgctgggggtgtaacgggtaacacagtggatgaacaggataatggcgattgccacaatcaggggcaggcccaccacaccgaaggcgatcttgtaccactctacggtgccccacagggctttgggcaccgactcggggttctgcgtgatgaggagggccaccgactgccatagggacataaagcccagggaggcgatgaaggagggtaccttcagcttgacgtgaatgatgcccagcgccagaccggaggccaggccaaacgccagagagaccgccatggccgccaggctggtgaggagaggattgctgaagctgtcctggaaggccagcatcaggtggatgtaggtcacgttggatacggagcacaccgcgcccatggacaggtcaatggagccgaacagaagcaccattgtcatgcctgcggacataatcatcagaggcgccgtgtcgcgcagcaggtttttgaggttgctggtgcccaggaagttgtcctgggtcagggagagggctaccagcagaataatgatggccgaaaagctaaagtattttgtgatgttgtcccgcagccatgcactcctgccggacacattgggagtttttgtcttcatagctcgattcctccttacatcatcaggctgaccacgtcaacctgggagggcttgtggtcggcgggggcgtcaaattcgccggtgaccaggccgtccttcatgacgagcaggcgggaacacaagccgatacattcgtctgttgtatcgcccagtacgattacagccttgccctcatccgtcatgtcgcggatcagggcgtagatctcctccttggcgcccacatcgacgccgcgggtggggtggttgagcagcaggatgtccgcaccgctggccagggcccgggagaataccaccttctgctggttgccgccggagagctggcgcagcagcgcctggggcccgggggtcttgatccgcagctcgccaatccagtgcttggcctgcctgcgcaccgccgcgcccgaaacaaaggggcccttggccatctgcttggcgttggacagggcaatgttatcctccaccgacagggtagagacgatgccctcaaacaggcgctcctttgggatcataaggatgccctccctcagcgcctgcttgggcgagcggaagcggacggccctgccgcggaccgagatttccccgaaggagggcttctcgtcgccgcagagcacctcgcacacctcttccgcgccggagcccaccacgccgcacaggcccagcacctctccccggtgaagctggaagttgacatgcttgaagattccgtgcaggcccaggtctttggcctccagaagtacatcatcctggggtgcggtctggcggtccagatggtagtactccgtggtggtggactggcccaccatcatttcgtacagcttggcctcgtcggcgtccctggtgtccaggctgcccacgctggtgccgtccttatagacatagatgcggtcggtgacctccagaatctcgttgaggtggtgggaaacaaagatgaccgcatggccctgggccgcgatcttgcgcatctgcttgtagaggttttccacctcagcctcgttgagcacggaagtgggctcgtccagcaggatcagacagtgttcgctgccggactgcttggtgacgttcataaccttggcgatctccaccatctggcgggtggcgaagttcagatcgctgacctttttggtggggctgatgttggtgatgtccaccgcggccagcacctcggcggccgcccggttcatcttggcccagttgatgacgccggccttcctgaagtccttttcatggccaaagaaaatgttctgggccacgttcagggtaacaatcagggactgctcctgaaagaccatgcccacgcccgccttgttggcgtccatgggggtcttgggttcatagggggcgccgtggaagctcatggtaccagaggtctggggctgggcgccgataatgatcttcagcagggtggacttgcccgcgccgttctcgcccaccaggcccacgatctcgccggggtggatctcaagctccactcccttcagggcctgggtgccgccaaaggtcttggtgatgtccttggcgctgaagaggacctccgttccaatccggcggccgtccttggtcacggtctccgccactgcggaggggccgttcttgcgttccagttcactcattctgcccgcccccttatttgctgatgaccttggcgccgcgggccgcagtcaggatgacggccaccaggatgatgacaccctggacgccggtgcggatgtttgggttgacgttcagcatgaccaagccgttatccagcaccgtcataatcagcacgccaacaatggtgttgaccacgccgcccttgccgccggccagcgaagtgccgccgaccaccacggccgcctgggcgggaaacatcttgtcgtcgccgatggcgatctggccctggcccaggcggatagcgccgatgacgcccgccacgccgaacaggaaaccggccagggtaaacacgccgattttgactttttccacgctgacgcccacggagcgcggaatgttctcattggtgcccacggcgtaaatatgccggccgaaggcggtatactcctgaataaaaaagcacagcaggaacatcacaatggcaacccaggtgataaaggggatgcccaggaaggtggtggtgggcagagccgtaataacggggtccttgatcgtgggaggatgcccctggtaagagaccataccgatgcccttgcagatgtacataaaggcaaaggaggccatgaaggaggggattttgaggtagacgtggcacaggccgatgagcagaccgcagagcatgctcacacctaccgcaataaccacgctgaggaaacccagatcgtacgcaaattcactgttgaggacaaagcaggcaaacagggagcccgccatgcccacgcttccgtcaatggacagatcaatgctgcccagcataatgacaaaggtcagtcccagggccactaccaggggcagggccatctggttgagaatattcataatattcttgggggagaggaagctggccccacagacaatgagaaagacaaccacaagacaggccagcacgatcaacggtgccagcttcatcatttttgcgctgcggttttcactcttgatgcgttcggcgaactcttccgtgatggtcgccgcaggatttaatttcatcataatcgtcgctccaatttcgctctaggacggaccactccctcacaccacggcagcgatctctgacggcgagacttaatatgaagccggggctgggaccacgatcccagccccggccgttctgactatccgttattcaggattggtgctccggccggtcacccggccacgcggcagtcaaagggacggctgaagtcaaactccggcttgtagttctgccaatcctttgcggcctcggggctgtcaatcagcacagtgggggtggcaaactcgcggaagtcggcgggcagcgcggcggggtccagcaggccggcccaggccgcgtagcagatggccagggtatagccgccctggaggtatccattggaggagacggtagcagtggcctcgccgttggcaatggcctccacaatatcggtgttggcgtcaatgccgcacacgccgaccttacccttcaggcccgccgcgtccagcgcctgtagagctccagtggccatattgtcgttggcgcaccagatgccgcccacgtcggggtactgggtcagccaggtttcgaccagagccagagcctcgtcggtgttccagttggccgtgtcgtccgccacgacctcaatgttgggatactcctccagagccttctgaaggccctcataacgggcgttggacgcggtgttgcccagcaggccctgcaccacgaagatctggccctcgccgcccatggagtcgaacagggccttggcgatattgtagccgttcaccacgttgtcgggggaggtgtggatcacccagttggggtccagatcggaggggcccacatcggcgggcttgttccaggccgtgcccagatagccgccggactccgccatggcttcagccagggagtaggcaatggtgtcctcgttgggatcggcgtaggcaatggcgttgccgttggccttggccgcaaactggcgcatgttgtcgacttccttggcgctgtcgccctgggaatccagcacctgcatctcatacttctgaccgatggaatccagatattcggcaaagagcttcatgccctcgttgatcgtggcgatgtacgggttctccagaccgcggacagagacggccaggtacagggtggtgtccagcttttcctgtgggatctgggcgggatcgatcacaaaattggcatagtctacgtcgttctgggcgggagtggtctcgccctgagccggggtggtttcaccgccgccagtggggctttcagccggatctgtgctgctgccgcagccggccagcagtccgaccagcatggatgcggagaggaccgttgcaatgagtttcttcttcttcattcgggtgttcctccttcttgtattgggttgccttgcttacaaaacggccgttgtccgcggccgactttgtgtttatggtatccggtttgcgccggactgcgttgcattgatactatgtagtaacatatcgttgcccttagtatagctcaaattttaaacttgtcaatatagctttcataaattggtgcataatttacgttttttcactgtccaaattattgattctgcacacaagcgtaataggaaccgtttttgtatcataatatatgcagtatcataccgcttatttccttccttttccatggaaatatgtataaaactcattttatttttacatctaatttagttgcatttttaaatgctttgtgttatgatctctcttgtaaatacatggtgctttgttttttatcttgttatgtagtgacattccaatattacgatattcattaaaggagggccttttttatgaaaacgctggtcgtcgagagagatggcaggattaccgttcacgaggtcaacaagccccggtacaacgagtatcaggcgctggttaagaccattgcctgcggcatgtgcggtaccgacatcaagctcatccaccgcacctttaagggcttccccgaatcggtctaccccattatgctgggccatgagggcgtgggcgaagtcgtggaggtgggctccaaggtcaaaggccttaaagtgggcgacaaggtgctgctgccctttgtggatcctgacccggaaaacctgcctgggctgggctccggctggggcgcgttgagtgagtacgctgtggtgtgcgatcccaaagccccctggcccggcggcgctcccgactgcgcctttgctcagacggtgctggacgacgatctggaccccgtggacgccactatgatcgtcaccttccgtgaggtgctctccaacatccgctatttcggtatccagccccaggactccgtggtagtgtttggctgcggccctgtgggtcttacatacttgaagtttatgagcctgctgggtgtaaaggatctggtggcctgcgacatcctgcccgaaaaactggagcaggccaggaattacggtgctactcacctcattaacagcaaggagtgcgatgtgcgcgccgaggtgcgcaagcttttccccggcggtgtggactacgtgctggacgcggccggttcccccgccattgtaaaccagggcatggggcttatcaaggaccgaggctcagtgctgtgctacggcgtgcccgagaaggaggaggtcaccatcgacttcagccctgccgactacaactggcgcgtcatttaccagcagatgccccgcaagcgcgaggaaggcgaggcccacgcccaggtggtagagtggatgcgctccggtgagctgaacattaaggactttatttccgactacttcacctttgaccaggccgtggaggcctaccagaagctgctggaccgcaagattctgaaaaagggcattattaccttctaaaaagtacaatgagaggcccccggcgcgttgcgccgggggcttttataatggcttcgcttccgtcagatccgtccgccgccgcgtccaccgtgtcgggggagatccccaccgccgaagccgaagtcggcccgcttgcggcggaggaaccagaccgacagcaggcaggagagcagctccgccagcggcacggccagccacacgccgtccacctccagcagccggggcagcagaagcagccccagcagcaggaagccgaaggtgcgggcaaacgagataatggcggaggtgcgcccatcggacagggcggtaaagagggcggaggagaagatatttaccccggcaaagaggaaagcgggggcaaaccgtcgaaagccgtccagggcgatggcgtacaccggagagccgggtgtggagaagatccccaccaccaccccggacagggccagggccaccgccagaatagccacggacgaaaccaggataaaccgcaggcagtagccgaaaatacgccgcatccggtcataccgccccgccccccggttgaagctgaacaccggggccacccccatggagaagcccatatacagggccaccagaaggaactgggcatagagcacgatggtgatggcggacacgcccgcctcccccaggtaggccatcataatagcgttaaagagaaaggtagtcaccgccatggacaggttcgtcaccatctcggacgcgccgttgaagcaggcccggcccagcatgcgcagatccccgtgggggcggccaaagcggagcccctgccggcggagcaggaaaaagagcacccccgccacggcgggaatcgagtagcccgtaacagtgcccagggcagcgcccagtatgcccatctgcataggccccatatagagatagtccagcacggcgttggtgacgcccgccgcagtcgccagccccaggcccaggccgggccgcccggcagtgacaaagaagctctcaaagaggagctggagcatggccatgggtgcaaagcagagctgcacccgcagataggtgaccgtatcgtccagcagcagatcgctggcccccagcagccgggccagcggcccggcgaacagggcccccgccaggcagaccgccaggccgatgcacaccgccaccagggccagaaagccgaagtccctccgggcctcctccagatatccagcccccatcttgtgggccaccacggcggagccgccggtgcccagcatgatccccatggccagggtaaagctgatggcaggataggccacattggcggcggccagggcgttctctcccaccaggcgggcaatcagcaccccgtccacgatggtgtagaggctgaccaccagcatcataataatggtgggcagggcaaagcgcagcagccccggcaggtggaagtcgcggtccaagcggttggtcatggataaatgtcctctctttctcatggctgtttctccggcctgcgaccggtacagatggcgcaaagtctggctccattataccattccgtaccgctttatggtataagaaaccactgtcggccgtcaagtgcggtatgaagccttggtcatggccggaggacggttgccgccgggcctgctttctgttataatggaattaactctaaggaaaatccgagaagggggcattttcatgcggaaggtgacctgtgcgagttgcggccggccctacgactacgacagcgacgacttctgtcccaagtgcggcagctacaatcccccgccggaccgcgcaggggcccgcccggcgcaggctccgcccgcccgcgtttcggccgcttccaaggaccggccgcgcccggcggcccagcccaagaccccaccggtgggcccccggacggtgtcctacggcggcccccagggagggacgccctgggaggagccccccgcacggaggcagcgctccccgctcaagcttctggtgctcgtgctcgtgtcgctgttcctcctctgcattgtcctgcccttcgtgttgggtcttatgcttaacctgtccgaagcctttgcgggccgccgcccagagccgggggcggttgcccaggcggagcccgccggcgggactcacgccctttgggagcccttttccattcacggtacccagcaggtgaccgtggaggacccctgggaggtggatctgacctacgtacccctggcccggcgggagggcttccgctgcctggccgtggatctctgggtggaggggggcgagcgccgggacgacctgaccttttttcccgccgagctgcggctggaggacggcaccgcccttctggcggaggacgacgcctccctggcccggcagctcaaggacgcgggggtatatctggtcaccctctccgacgcccagtgggaggaccccctgtacggccagatgatcttctttgtccccgaggatgcctccggcggggccgtgctggctttgtacgagggggagccggacagcagcaccccctctgccgtccatcagattcccctggagctgccctggggcgcggtcggaaccgtgtaaaaaggagcaaatcagattgaataacatcactctcatcggcatgcccggctcgggcaagagcaccgtgggcgtcctgctggccaaggccctgggctttcagtttgtggacgtggacctcctcattcagcagcgggagggggccctcctacaggagctgctggacaaccggggcgtggagccctttctggacgcagaggaggcggccatctgctccctggcctgcacgggcgccgtcatcgcccccggaggcagcgccgtctgccgggcgggggcgatcggccacctgagggccctgggccgggtggtctacctccacgtccctctgtcggagctggagcggcggatacacaacatcaccacccggggcatcgccatggccccgggccagaccctggccgacgtgtacgccgcccgggaacccctctaccggcggtacgccgacctcaccgtggacgtgggggaggggagagggctggaggagacggtagccgccgtgctccagggcctgctggggctcaacaccgcccaggcccagggctgagccgcgcccacttgtatttttccaaatttgtggtatactttaggagtacgaatatcgcgtgcgaaatgcccgctggttttccggcgggctttgccgcgttttcccccacctctgcgcggtggggtatgacccgcaaccgccccccggcgcaggaggggccaaaacgctgtaaaggacgaacaacatgacctttcaagaactcggcctcaacgagcccatcctgcgggccctggccgaccagggctacgagcagccctctcccatccaggcaaaagccattccccccgcgctgaccggccgggacgtgctgggctgcgcccagaccggcaccggaaagacctgcgccttcgccgcccccattctccagcagcttagcggccataaggcccagggccgccccatccgggccctgatcctcacccccacccgggagctggccctccagatccaggagagctttgaggcctatggcaagtacctgcccctgcgctccaccgtcatcttcggcggcgtgggccaggccccccaggtggagcggctgaaaaatggcgtggacatcctggtggccacccccggccgcctgggcgacctctacggccagaagctcatcgacctgtcccggctggagatcttcgtgctggacgaggccgaccggatgctggacatgggcttcatccacgacgtgcgccgcatccttggctggctgcccgcccaaaagcagaccctctttttctccgccactatgccccccgaggtgcaggggctggtggactccctgctgcacaaccccgccagggtggcggtcaaccccatctcctccccggtggaggtgatcgaccagaagctctactacgtggaccgcggcaacaagaccaggctgctcgccgccctcatccgggagctggacgtgaaaaacgccctggtgtttacccgcaccaagcacggggccaacaaggtggccggggatctggtcaaggcgggtatctccgccgccgccatccacggcaacaagagccagaccgcccgacagcaggccctggccgacttcaagagcggcgcggtgcaggttctggtggccaccgacatcgccgcccggggcctggacattgaggagctctcccacgtgttcaactacaacctgcccgacgtaccggagacctacgtccaccgcatcggccgcaccggccgggccgggcggggcggcaccgccatctccttctgcgacatcaacgagaaggacgagctcaaggccattgagaagctcatcggccgcgccatccctgtggtggaagtccacccctggcccatggaggtgctggagcccctgccccgcgacaagaagggccgggtggtgaatccagaggacgccgaggcccgggccgccgccaaggagcgccgccgccagcgggatgcggccaacaaggccgccgccgaggcccgaaagaccaaggccaaccaaaaggtactggagcagcctccccagccggagccagccggggagacctccgccaaaaagcgccgcaagcggggccagcgcaacagcgccaccctggaggaggccctgacggccactgcccccgcccggccggttcagacggagtttgccgacttccacaagcccgaccccctggccagcgacgtgatcatggacgccaccgcccgcctgctggcccctcgcggccgggcccagaccgcaccgaaaaaggacaaaccagttgaacagcccgctaaaaagcggaagaaggccgccaggcccccggaaccccctgcgaagccggagccccaggcggcgcggaagcgcaagggcggcggacgccacggcggccggggccgtcccccggaggtcaccctgcgcaccaatgggcagaaggactccaccgagcagcccagcctgatgaagccctactacctgagccatgactaaaccaagaggacgcgcacacctccggcgtgcgcgtcctctttctcttctgcggcgggggcaagagagacgcgggcggggacaagccccgcccctacagtcctgcgggtatcaatccgcctcctgaacaacgtaggggccgatgcccacatcggcccgccgatccggccgcagattgaccgcgggcgggtgtggacacccgccgctacatttctgcaatggtaccgctccctccaaatgtaggggcggcccttgtggccgcccgccccaaccctgcggcggggacaggacccgcccctgcaatcctgcgggtatcgttccgcctcctgaacaacgtaggggccgatgcccgcatcggcccgccgatccggccgcagattgaccgcggggggtgtgggcccccgcccctacggctctgcaatgacggcgtccccccgcaaaatatgggggcggcgcttttacgccttcttgggcgggtggagccaccggccgaagcggtagtagagcaggatggccacggaggtgaccgcccaggtgatggggtagctggcctccacagccagcagggtgtggtgggcgggcacgacggtgaacagccacagcagccgcaggccgcacaccccgaagaccgagatgagcatgggggctaccgacttgcccgccccccggatggctccagtgagcagctcgatgagaatataggtgatatagcagggggccaggaagcgcaccatctccactcccacctccagtacgtcggggtcgggggagaagatggccagcaggggccgggccagcaggaaaaaggcagtgctgagcaggacggtgaagcacgccgtcatagccaccgacacccggacaccctttttcaggcgctcatactccccggcgccgtagttctgcccggcaaaggtggtgatggactgggccatggcggtaatggtcatccagaaaatgatatccatcttgccgtaggcggtccaggcggccacagcgtcggtgccaaaggagttgatggaggcctggatgacgatattggaggcgttgtacatcaccgactggagggcggtgggcacaccgatcatcaggatgctgcgcatgggcatggcatagatgcgcagccgcttgggaaagagctgatagggggtcatctcggagcgcatgagtgagatcaccaccagcacggcggacagaagctgagaacagatggtggcgatggccacgccggccacccccatatggaacactaccaccagcagcagatccagcacaatgttgcacagggatgcggccatgagaaagtagaggggccgccgaaagtcgccgatggcccgcagcacgccggtacccatgttgtagatgacgttgggcaccatacccaggaaatagacccgcagatagagtatggccccgggcagggcatcctcggtggtgcccatggcccgcagggcccagggggtgaggacaaagcccgtcaccataaaaaatgcgccgatgaggatgctcagcagcatggcggtgtggacgcactcgtgcacctcgtcccagcggcgggcgccgaagtgctgggcgatggccaccaccgctccggccgccaggccggtgaagatgcccaccgtcaggttgacgatgacggaggtggagcccacggcggccagggccaccttgcccacgaaccggcccaccaccagggtgtccaccgtattgtagagctgctggaaaaaggtgccgaaccacagggggaagaaaaaggcgaggagttgtttccagatcacgcccttggtgatatcactggtgggctggcgcagcagtcccatgggagatccctccatattttgtcgtatcgttaaaggagcgttaagattctacacgcttcctgtcggaaaagcaaggggggcgcgccgttttcccctgcaaaaatgcccggacggccagaacatcccaccgctgcgcaggcggctgtttgaattggcccggcgcgcttgttttttccaccgggatcggatataatgtggaaacgaacataccgaaagagggtttttaccgatgaaattaggcattgtgggccttcccaacgtgggcaagagcaccctgttcaacgccattaccaacgccggcgctgagagcgccaactaccccttctgcaccatcgaccccaacgtgggcgtggtggccgtacccgaccaccggctggacgcgctgaccgagatgtaccaccccaagaagaccacccccgccgtggtggaatttgtggacattgccggcctggtcaagggcgcctccaagggccagggcctgggcaacaagtttctggccaacatccgggagtgcgacgccattgtgcatgtggtgcgctgcttcgacgacgagaacatcatgcatgtggtagctgacaccagcaccaacgtgcccgtggaccccgccggggatatcggcgtcatcgacatcgagctgatcatggccgatgtggagatggtggagcgccgcatcgacaaggcccagaaggccgccaagggggacaagaagtatctccgcgaggtggaggtgttctccgccctgaaggactggctcaacgacggcaactccgcccgctccttcgactgtgacgaggacgacgccgccatcatcgccgccgccgagctgctctccctcaagcccatcatctacgccgccaacctggatgaggagggctttgccgactgccacgccaacgcctactacaaggtggtggaggagctggccgccaaggagggggcccaggtcatccccgtctgtgccaagctggaggcggagatcgccgagctggacggcgaggagaagaagatgttcctggacgatctgggcatcgccgagtccggcctggaccggctcatcaaggccagctacgccctgctgggcctgatctccttcctcacctccggcgaggacgagtgccgcgcctggacgatcaaacggggcaccaaggccccccaggccgcgggcaagatccacaccgactttgagcggggcttcatccgcgccgaggtggtcaacttcgacgatctgatggcctgcggctccatgaacgcggccaaggagaaaggcctggtgcgctccgagggcaaggagtacgtcatgaaggacggcgacattgtgctgttccggtttaacgtgtaatctggaacgccgtccttcatgaatcccgccaaaggcggcgcggcgcccctgcgccgtgcaggcgttttgcccgcaaaaccctgccagccggtggaattcacttccaccggctgtttttcaattcggggcccccgcggaatgtattccgcggggctggacggcgatatcgtgctgttccggtttaacgtgtaatctggaacgctgtccttcatgacccccgcctccggcgggcgaactgcaatcagcataacagaggccccggaaccgtctggttccggggcctctgggctgttgagcgccttgactgtctacatattctttgtggtaatccagtccacacccgttccgcagatatcctgaaccaccaccgctccggcggccaccggagcgctgaggcggactttttttaacagattcatggcttggataatcaatctctttggaatctcccccgaggtcttgaccgggcagcaggggtgaattgccccttctatccgaacaatgctggtcaacgtccgggtgggcgctgtcagctccttatgtccatattcctttcccctggggcatccataccccgtaaccagaaacccgttctcctcatccacattcaggcgacagcccttggggcacacaatacaggtaagctccgtcattccttcgcccccctttccgccgccagagaaaccgtcagtttcccgtcccccgcccgctccagcagacgcttgggcaggacaatgtgctccatctcacccggagccatgtgctccctggagaagctgcatagctcctcccctgaagaggtcacgcagatacgacggttccggtacacgttgtcaacccggaaaaagagatccacgcccttctctacatgggcgggccgtatcttctgcggcaccgtataagtgacccccgcgccattctgcacctccaggcaggacagggcaggggagctctgacctgccgccgcataccgggccgccgctgcaccggcccgccggctctccgccgtgacaaagtcgaccagatcatggacatggacgacattaccgcagctaaaaattccgggagtcaccgtttccatgttttcaaaaactacggcgccgctggttcggctgtcaatgggaattcctgcggcgcgggtcagctcgttttcaggaataagtccaacgctcagcagaacggtgtcgcagtcaaacttgatttccgtacctggtattggcctgcggtcagcgcctacctcagagaccacaacctgctccacccgctcccgccccacgatattcgtaatagtgtgagagaggtaaaggggaatcccatagtccttcaggcattgcacaatgtttcggtttaatccattggagtagggcatcagttccacacaggccaatacgttggccccctccagcgtcatgcggcgcgccataatcaggccgatgtctccgctacccagaataaccacccggcggcccaccatccagccttcaatgttaatgtatcgctgggcggtaccggctgtaaaaattccggccggacggtctcccggaatggcgatggccccacgggtacgctcccggcagcccatggccagcacgacagcacccgcctggatctccagcagtccgtcccggcaattgaccgcacgaaccgtgtgatcctcctccacagagagcaccatagtatccagcaggatctctactcccagctcagaagcccgctgaataaaacgtcccgcgtactcagggccagtcagctcctctttgaaatagtgcagtccaaagccgttgtgaatgcactgattcagaatgccgcccggttccttgtcccgttccagaaccagcacccgctccgctcccgcctcacgcgcgctgcaggccgcggccagtccggcagggccgccgccgaccactaccacctgatagttaagcgtcatggacggacacctccttgatgggggagctgagcagccaggtcccctcctcatccattgttatatccattggggaaacacccaactcacgggccaggatctcatgcacccgggggccgcagaatccgccctggcagcgccccatacccgcgttgcagcggcgcttgatggcgtcaatggaacgggggacaatgggacggtgaatcgcctcaacgatctccccctccgtcacggtttcacaccggcagataacccggccgtagagcggatcttcggcaatcaccgcggccttctccgcattgctgagttcccggaacttaatgcgcctgcgccggtcgataaacgtctccttttccgtcagctcaagaccgcacccggacagtatgcgcaatccctccagggcaatggccggagctgcggagagtccgggtgacttgatacccgccaggttgatgaaatgaggacaaatgggggactcttcaataacaaagtctggtatttgcgtattgggacgcactccggcgtactcatgaatcgtctgacggaagtcaatgcccggaacagagcgcagtcctccgctcttcacctgactcagatagggttcgaccgtggccacatggtcaccatcctccacctgatatgcgtcgggacccacaatcaggtttccatgaaccgtgggggccaccaggattcccttaaagccgtgctcgtcgggacaggggaataccacggagttaatgatgcccccctggcttttgtccagaacgtaatactggccgcaaaaatttgtctgtttcagcccgcggccccccaccagctcataaacctgggcggaaaaggcccctccggcgttgataacatagcgggcttcatagcttccggaactggttgtcaccacaaagtgatcctcattccgctcaatcccggttacgcgggatgacaacttcacctccacgccattgcgtactgccgtctccgccatggcaacggcgtactcccagggattaataataccggagccaggggcatacagggcgccgatcagcttgggattgaggccaggctccagccggagcgcctcctcccggtcaataatacgcacgcccggtacgccattggccacgccgcggtcatagagctcccttacatactccatctcccgctcgtcaaaggcgatcacaaacgaggggatatcccggtactctacatctagtttcttgcagatttcccgggccatagcaatgccctccaggttcatgcgggcctccaggctgccgggcgggcagtcaaagccggcgtgcagaatggcactgttggccttggttactccgttggccacatcgttgaaccgttcacatacacagaccttcagttgataccgtgacagcgtatacgccatggcagacccaattactccgcagccgatgatcagaacgtcatacattagtttgaaaagcctcccttaccaccatttgatttgatcggtaacatactggcggattttggtaaactccggcgaagtcacatcgcggggccgcggaaggtctaccttgaagtcctctttaattgtagtgggtttgttggtcaggatcagaatgcgttcggcgaggtaaacagcctcctcaatgttgtgggtaataaacagcaccgtgctgcctgtctccttccaaaggcgaaccacctcgtcctccaggtagaagcggagtttgatgtccatctgcccatagggttcatccatcagcagcagatccgggttcatggcgaaggcccggccgatgataatacgctgctcggtactcaccgacagctggtgcggataggcgtcacgaaagttttgcaggcccatcagcttgataatgttttccacccgctcgtcgatctcttttttgggcagctttttcagctccagcccaaagcgcaggttttcctccaccgtcttccagggaatagaggacggctcctgaaacacaaaggccaaattgtgctttttggggtcggcggactctccgtcgatcagaaggtcgcccttggatggcatgtaaatgcgggtcagcaggttgagaaacgtggtcttaccgcagccggtagggcccacaatacagataaattcaccctttctgacattaaaggagatgtcgttgagcacgtgcagatccccaaaatattttgtgaggttcttaacctccaccttgtattcactctttggttcgctcatccttaaccacctccgtcagagcgccagatccgtgttgtcactaatgattttccgcaggcgcaggaactcagggctgaccgtatctctgggccggggcaggttgatgtcatagatttccttgacctgcgcagggtagttggtcagcaacacaatgcggtcggccaaatagagtgcctcctctatattgttggtgacgaagataaaggtgcgcttttcactttcccagattcgcagcacctcgtcctgcatggaatatcgggtctgggcgtccagctgtccgaagggctcgtccatcagcataatctccggattgttggtataggcgcgggcaatgcctgcccgctgcttcatgccgccggagagctggctgggatagcttttttcaaagccctgcaggcccaccaggttgatgtacttctgggccgtctcccggcgctgagccttgggcacacccttcatcttgaggccgaactctacgttttccattacggttttccacggcatcagcgccagcttctgaaacaccatgccaatacgctcgtcgctcccatggatctcctctccatccaggaagagactcccgtccaccggcttttccagcccggctatcatattcagcagtacagttttaccgcagcgcccggggccgagtatgaccagaaactcattgtcgtacacatccagagacacgtcaaccacggcgtctgacacctcatttttgacaatgtagctctgagaaatatgctccagtctcagtttgactttcttgccgtccatggacaaaccatcctttctaagagctgggtaatgatggccagcagcgcgccgaccaaaccgatacacaccatggacaacagacacagggcatagtctccggagtccataccgcgggtaatgaggaaaccaatgccggactttccgcccagcatctccgcagccagcaccaccatccagccggcagaggtagaggttctcacaccggcaaaaatggcgtccagagccgatggaatagcgatttcaaagagcatctgccgcttgttggcgtggaaaatggtacccacattgaggtacatgttctgcacattggaaatgcccgcctgcgtgttgaccaccaccggcatcagcgcgccgataaatacaatcagaattttgggaaattcaccggtgccaaaccacatggtcatcaatggcacccaggccaggggcggcacggagcgaaaggcggtaaagaggggccccagtagtgcgttggccttcttgttccagccgatcagaatgccgaaagagatcccaagcagccaggcaaaggccagggcaataaatacgcgcagaaggctggcccaaatgtgaccaaagaggttgagctgcttgatcggtttttccatcagcagcagaaatcgattccaaatatccacaggagagggaaaggtgctgttttccgcgcccgcggccaaaaaccacagcaggatcagaagcaggacggaaactacaggaaacacggcgtaaatccggttgcggagtctctcacggcgctccgcgtcgctcatgacaacaacactggtactgctctgtttcatcgtttccacctcagcactttcttctccagcagtcccaggaccgaggtgaaaatgacgccgatcacgccgatgacaacaatacccaggataatgatgtcggcccgggcaaactgtcggccctggaggatcatgtacccaagtccggcattggccgccagcatctcagcggccaccagcgtggcccatgcgtttcctagggccacgcggatgccagcaaaggtcatggtcatggcagacggaattccaatcttgcggaacaccgtaaaattggaggctccgcaggttttggccacattgatcagcaccgggctggactgcttaatgccggtatatgcattgataacacagggtacaaaggctgaaaagaatacaataaatgccttggcctgcaggccgattcccatccagatgatggtcagcggaatccaggaaaccggcggtatgggccgcagaatttcaaagatgggccgcataaatttgtcgaatccccggaaccagcccataaaaagccccagaggaattccgatgacaatcgccagcagaaaacccgtcagggccacctggaggctggccatgatgtgaacccccagcaccgcgccgtccggattgggatccaccagctttgtagcaaacagtgcgataacctccgtaggcgccgggacgtagcggctgggcagaacccccgccagaacagctgcctgccagagaagtagaaaacccaatatgccgatgaccgacagcatggccagttggaagctgttgcgctttttctgccgcttgaccacttcgacgcgctcctcgttggtcagcttccggcccgcgctggaagcattttgcatattacttcccccttacaacaagtttccccgccgtttggcaggcaaggaggctgcactgcgtgcctaagcggaacgacaatgcagccccgggttgcgcagatgtgcagctgattattccagatagcccagcgttttaagcgtctcggcgcaccgctccgccacagaggagttcaccagctccttatcaaggatggcggtacggtcttcctcagtatagctgccgatggagatgaaaaagtccattgtctccagcagatcgttttcagcggccaacaacggacgatccgccaagctaaggcgatcctcttcctctgtagtcatcacgctgacggcctcagaggggctggggcaggcaaagatatccaaagcccgctgacagatgctttcattggataccacaccctcgtcctcgcaggactccacatagagttccaccgcctgcgccatattgtcctcgctctgctggcaccagtcccaagtcagataatagaccatccaggccaggtcgatcaggtcgctcttattctccatagcatcctttgtggccgccagtccgcagacattgttgatgcccaattcgctgacatcggtaatacggacgagtccgctgtcctcggcgttgtatgccacggcattccaaacgcacagtgcgtcgccctctccggcattgaaggcggtcagcgcgggcgtaacatccatattggtaattgtcacgtcatccgcggaaagtcccagtgactgaagatagctgaggaacatgtactgcagggtcgtaccggtgggcagaatgcactcaatccctttccatacttcaggattggtaggatcggcggcctgagggctgtccggacggacaaacagggcggtattgtactcgttgtcgcacaggcccagcatctggatatcatagttcttcatgccgttcagaataccgggagcacccacatcacagatgtcccagctggcgcaggcctccatcatggccgggccgccgataaaggactcatactccacatcgatgtttaattcatcaaaaaatcccattctaacagcaatataccagggcatggagtgggcagagccggagaaaaaaccgatggtcagtgtggtgcgctccggcaggggcgtcaggccgaaggtcgtttcagcggcgtccagaggctggttgctcgagtttcctcctccccccttcgggccacatccggaaatcagtgtgcagacaagagcaaacgaaagtacaagagacaacagctttttcataatcattctcctttcaattattggaacccaatagaccgggagcaatgtttggttcctcacccctctttcctcggccactccttgcggctcagccgccgcaggggcagccgcccacgggggcggagttgagggcggggtccttcatgcagaggtggacggcggcggtggtgaaggtgcggggcagggccaggatgttggggttggggccggtgtacttgcgcatggcgtcggccagggcctcctcgaaggtggcgcgggtcttgaggcccatgctgcgggcgatgcccggctcccgggcgcccacgatgtagatggcgctggtgtgctcctcggccaggtggccgcagctcatcatggagaagccgtggaaggggtggaaggcgttggcgaagcggtacttgcggatgtactcctccttggtggcgaagtactcgccgtaccggttcatgtcggggaggatgttcatgtagtcgtgctggaacaggtcgtacagctcccgcaggtagggccaccgctcgtcgtggaagtagccttcgcagatgctgctgacgatgaacacacagtggtcgctcatgatgcgcctgtggcggatgacctgggcggacagagcctgcatcatctggatggggttggtgcccatgccgttgccgtagtggaagttggtgggcatgccgaagacgatgatatcgtacttcttctccgcccagtggacgtaggtccgcttgtcggccatcttccaggagacgggctgcatctccctggcccagccggagttgatctcaatctgacgggacttggtgtccagcaccgcgtcgcagcagaagaacttcttgcccatcttctcttccatcagcatgccctgctggtcgaacttgtggcgcatctcgctgttggtggacacgggcacgaagtcctgccggtgcatcacctggggcacgtggtgggcggagatgctccgccagtgggagatgccggtggcgcagtgcttgtagccgccggagtagccgccgtaggggttgcactgggtgtgcccgatgagcaccgccacgtccgcgtcgtagacgtacttgttcatgatcacgtggtccccctgggcggtgtagcccaggtctaccaggtggtcgtagtcctcgctgtcgtggctggtgatctggccggtggggtagaactcgccgaacagctcggggcccaggatggtctgcatctcggccacagtagcacgggggtgcaggccgttggagaacagcagcagcacgtccttctgctccaccccggcggcgtacagctcgtccaggcaggcacggatggccaccttccggtggctggtaggctggttgccccccttgacgatgtccggaatgacgatgaccaccgacttgcccggcccggccagctccttcagcgggggcatgccgatggggttgcggatggacgccagggtagcggcgtacaggctgtcccagtcctggggcagacagggcggatccgctaccgtctccccggggatgaagatgtccgtgctgtcgggcagctccgcgcccaccaggccctgcccgtactcaaattccagtttcacaaaatcacctcttctaatttacgcaaatttgctttaagaaaagttaagtttattcctaatactttttatgactatataatattactaaattacaccaagatattaacacactatatcattaacttcaacaatattactcaaactttggcacccatttttaagcaatcgattgttttttgtgctaattttattaatttaatacaatatagagtagtataccttttacatattgcacataatgtaaaaaattttacaaatatcttgccacttggcacgagagttcataaaatttcttaagtgtatctcttgttttactcaaaatttgtgttaaaataataacaaattattcaaacagggaggcgtatcatgacactcaaagaaattgcgaaagaagcgggcgtttccatctccactgtctcccgtgttttaaaccagccaaacaccaaagcggccagcgctcaggtacaggagcgcatctggaacattgttcgaaaaaccgggtatgtccccaatccagtcgcacgcgagctccggcatgctttacagcccaccccggttatgcagtctatctacggattaattgcctgttcccccggggaggtacgggatgacccctttttcccccgcattatctccagtattgagcaggaagcatttcaaagcaactttgtactgaaatacacctattccatgctggaatttcaaactccggcggcagcacgccagtccgggggctgtgactcagacaacctgatcattgtgggacggtttcagccctcgctcctcacctccatgaaaaaacgattccgcaatattgtctatgttggcctcaataatctggaggctgaatgtgaccaggtactctgtgattgtttttttgccgttcgggataccgtacgctatttttatgaccggaatcatcggaatatcgcttttattggagcagagcaggagggacgctaccgtggctatttagaagggctccgcctatgcggcctgcccccttgtccggagcatctggttcaaatcaatacgctctccatggacggcggtcttcagggtatgaagcagcttctcagccagaaccgcaacattacagccgtcatctgcgccaatgatatgaccgctatcggcgcgcttcgggcctgcaaggagttgggcgttcaggttcctgacgaaatttccattattggaattaacgacattccaaacgttcgctatgtccagcccaaaataagcagcatacacgtccctttggatgaaatgggcaagatggcagtccgtaccctagccgaccgaatcaatggcggtcaccaactgcccgttaaaattagcttgccctaccatatcgtcgaacgcgccagttgcatgccctgcgccagaccttccggaaacatgcagacgtaactgcgcgcaacatatctccccgctccgacgcatatacatgccccgtgagaatcattgcggggagtgttgctgtttgaaagggaacatcgaggagcgcgcctgccagctggcgctttacatcatagagaacaaagcgacggtgcgcagcgcggcccagaggttcggcatcagcaaatccacggtccacaaggacctaagcgagcgtctgcccgcctttaacaagcctctttacctccaggtcaagcaggtgctggacgaaaataaagcggaacggcatatccggggcggtatcgcaacccgcaaaaagtaccggggagtcacctaaaaagcagcggcgcacgggtatccgtgcgccgctgtagcctgtcaaaaaagtccggccggacttttccgacaggctgccggactttttgatgtctcaaaaagtcattctattttacgcgaaagggaaccctgacggttccctttcacactttccctccctccggcgcctttggccggaggcattatatgcaatcgcagcggcgcacggatatccgtgcgccgctgcttctatcatccatttatctaaattctgacgtcttaccagccaaagggccagggaaaatagccgccattctgctggggctgctgctgttcctgctgggcctgctgctcctgataatccttctggagctgctccatagcctcctgggtggtctggttatcctcatccagggtgatctcaagctccactgtgtccccgtcccggtaaacggagaaggtcaccttatcgcccgccttacagtcctggacggcggctttgagggcctcgctgcccgacactgcagtgccgttgacagcggtgataatatcgcccgcctggaggccggccttgccggcgccggagccgtccaggacagccagcacctccgagccggcgggaacgccgtactgctgggcctcctggggcacgtccttcatcagaatgcccacgttgggtttgccggtgacgtagccgtgctcaatgatggaggtaaccatatccttcacgtcgttgatcgggatggcaaagcccaggccctccaccgaagcctcggagttggagctgctggacagcttggcggagacgatgccgatcacctggccgtactcgttgaacagggggccgccggagttgccggagttgatggcggtgtcggtctggagcatgttcattaccgttccatcgctcatggtgacggagcggtccttggcggagacatagcccccggtgaaggtaaaggtcagctcgcccagggggttgccgatggcgtacacgtcctcgcccacgttgagctgatcggaatcgcccagggtgaccgtctggaggttgcccacgtcgattttcagcacagcgatgtcgttctccttttcaccgcccaccagggtggcgtcatagctcttgccgtcggagaaaaacaccttgatgtcgctgacgccgtcgatgacgtgataattggtgaggatgtagctggagctgccgttgctgccgatgacgaagccggagccggatacggcgttcttcaccgtatagccgaacacattggtatccacattgccgttgacgcccaccgtcgcgcccaggttggcggcgtagatctgctcgggtgagaggacggtctgcccgtccacatgggccagggatacgatgctgttgggggaggtaccctggtaaatagtggtctttcctccgctcagatggctggcggccagtacgccgccgccgcccaccaggccgcccaccagggcacagcaaaggcccagggccacaaacctggccgccccgctctttttcctggggggcttgggggactcagcgtcccagacgtgaaaatgctcggtctctatgggctcccgctcctcagggggtctgttatagtcactgttatacataactggtcactcctttgacgggttcatttcttttaacggtacatagaataaccgcaaattatgtataaagcgtgaagaaaatttgcatgttttttaaattccgcataaaacttcatgcgcacagggcgcaccagaaagcgatgcaaaggcttagggcttatttgaaaattggcgatgtgcccagcggcgaggaatttggggccgctggcaagcaattttttcgcaggaatcctgacggatttcaaggaaaaattgcgccgtccagcggtcaaaaggcccgtcgattgggcatgtcgacatttttcaaacaagccctaggtgcacgaagtgtttgcgcacgtgggccgttccggcccacacgcagtcatcccatggccgtgctgctgtaagcggaacatggccaattttgctatgcgtttgcatagcaaaagccgccggcatagccggcggctctgttaggcaggctcagatggggagggccttggtcagggtgaccgcccgggcgccggggccgatgtggcaggccacggagagggagagggggtccatgtggatggggtagccgggaaaggccgcctccagctcctccagccactcctgggcctcctcccgcgttccggtaaaggcggcggcgatgtgaaggtcctccggcccgcggcagccggcgaagtcggtctccatcaccctgcgggcggtgtccagcatggtcttcttggcggccttccagccccgggccttggcaaaggagtccagcttctcgcccttgatgcgcagcaccggtttgaggttgagcaccgtaccgatggcggcggcagccggggtgcagcggcccccctttttcagatacttgagggtgtccacggtaatatagatgtccgagtcaaacttggtctgttccagcagcgccttgatctccgcggcgctccggcccgcggcggccagggcctgggcgtccagcgcagactgccgcagggtgacggagatgcgctggttgttgaccacctgtacccttccgccgtagtcctgggccagcatcaccgccgtctcgcaggagctgctcaggccgctggacatggggatgtaaaccagctcgtcatagtccttcagaatccggtcccacagctccagcacgtcgccgggggcgggctgggtggtcttaacgtcggccccctcctccagacgctggtagaactgctcctgactcagggtgatgtcctccagaaagagctcgtcgttgatgtaaaagggcatgggcatcacaaagatacccagctcccggccctgggcctgggttatgccgctgttgctgtctgtggcaatggctattttgctcataaagaacctctctcccatcgttgcgatgtgggtcttgttcatccccgctccggtgcgccgcgccggaagaactcggccacccggcctagggcgcggagggtgcactccgcctcctcgtcggtcagtccgtccaggacatgggccaccatctgccggtgaaagtcccggtggcgcgcgtcggcggcccggccccgctcggtcggcagcaggtgtaccacccgcttgtcgcgttcatcccggcggcggagcaggtacccctttttctccagcaggtttactgcggaggtcagggtgcccgctgtgatccccagggcggcggcaatggcggtggagcggttgtccccgccctgatccaccgcccggcacacggcgtcgatcaggtgcagctcccgcagggagaggtctttcccggccaggcaggcggcctccgccttcaggatctggccaaacacctccaccagaaactggttgagcacctctccgcggctctccacccggaccgccccctctgcattcgatcgtaaaagcattatatcgaattgactgaaaaagtcaagacaggccctctggcatattccccctgtggggcgcatagagatccatatccgcccccgagggggacatcttacttacaaaggatgatgaactatgaagcccagaattcaatggggccgcctgctccgccgcagtctcgccctctttctggccaccctggcggtatgggccctgctggtgtgcagcggcggaggctccgccgccaatgccttccgcagtctggggcaggaccccggctttgtctccgccgccctctccgcagaactgggacaagtagcggaggacgacggtcccctgtccggcctgagcggctgggcccgcctggtggtggaccagtctcctctgctgcgggggaatggggacgccgtggccggccatctggacggctctgcgcccgccacccccgatctgcccgccgggcagcccgcccaggatcacgacgacatcagcgagccgcctcccgagaccactgccgcgccggaggacatcattgcccgcaccctggttcccaccagcacccagggctatgaggtgtccgggagcctgtacctctacaaccgcaccgggctggacgtggatctggccgccgccgcggcagcccccgtaaacattgccctcccggcggagggaccccagattctgattgtccacacccacggcagcgaggcctacacgcccgacggcaccgacatttacgagccctcggacaacaacacccgcactctggacgaaaactacaacgtggttcgggtgggggacgagatggagcgggtgttcaccgagctgggcctcaccgtggtacacgaccgcaccctatacgactaccccaagtacaacggggcctatgaccgctccgccgaggcggtacagcggtacctggagcaatatccctccatcaaaatcgtgctggacgtccaccgggacgccctggtgggggaggacggcacggtatacaaggccgtcacccggatcgacggggtggacaccgcccaggtcatgctggtgctgggctccagcgaggggggagaacaccccaactggatgcagaacctgtccctggcctgccgcatccaggagagcatgaacaccctctatcccaccctggcccggcccatgaccatgcgctcctcccggtacaaccagcagctctccaacggttctctgctggtggaggtgggcacccacggcaacacccttcaggaggccctggccggggcgcggctctttgcccgggcggcggggcaggtgctgctggggctgaaggagtgacgggcggcaagagaaaaggcccccgccggcgcgcgccggcgggggcttcgttttggatgatcagtccagcaccagctccacggggcagtggtcgctgccctccacctccgcgtggatgatgttgtccctcacccggggaagcaggcggtcggacacgataaagtagtcgatgcgccaccccgcgttgttcttccgggcgttgaagcggtagctccaccaggtgtacgcccccgtccggtcggggtagagggcgcggaaggtgtcggtaaagccgctggagagcagctcggtcatcttgccccgctcctggtcggagaagcccgcgttgccccggttgctcttggggttcttcaggtcgatctcctcatgggccacgttgagatcgccgcacagcaccaccggcttctttttgtccagctctatgaggtaggcccggaagtcgtcctcccactgcatccggtagtcgatgcgggccagctcgttctgggcgttgggggtgtagcagcagaccaggaagaagccgtcgaactccgcggtgatgacccggccctcgtggtcgtgctcgtccagaccgatgccgcaggtgacggacaggggctccacccgggtgaacaccgccgtgcccgagtagcccttcttttccgcgctgttccagaagagccggtagccgggtagctccagcgcgatctggtcgggctggagcttggtctcctggaggcagaccacgtcggcgtccacccgctggaagaagtccagaaagcccttgcccaggcatgcacgcaggccgttgacgttccaggtaaccagtctcatgcctctccctcctccggcagccatttcatgggcctgccctcgctgtccagcaggggagtgaggccgccggcatagccgctcaccgtctggaggtagagcacccccgtccgggtgtccagcaggatacgggtgatatccgtgatcccctgggtatagatgatctgaaagcggtcgttctttcccatcggtcaggctcctttcttccgcctgcgggcggacatgagcagtataatcccttattcattgtttcatccaaccgggcttcggcacaggactcaacctcagtacctccgcaccacggccaccaccttgcccagaatggtacagccgtcgccgtcaatgggctcatagtccgggttttccggcataagccaggtgtgtccgtccctgcggcgcagggtcttgaccgtggcctcatcctcaaagagggccaccacgatctccccgctgcgggcgtcctgctgctggtgtaccaccaccaggtcgccggggaggatacccgcgtacctcatggactccccccgtacccgcagggcgaagtgctcccctgtcagtcctccggtgtcaaaggtcagatagtcctcaatgcactcctgggccagaatgggggctccggcggccacactgcccaccacaggcacctggtcgggctcctctcccgccggctccggcgcgcccgggtgtgggccgctgatggtaatggcacgggtctttccctcggccttggtgatcagccccgccgcctccagccccttcaggtggaagtggacagtggagggggacttgagccccacatactccccgatctcccgcaccgaggggggatagccgtggaggccggagaaggaaacgatatagtcatagatctgctgttgcttgggcgagagcgttttcatggcagaccctccttattggtatactcccaagccagtatagcatagcctgggttaaaatgcaaacatatgttccctaaaaccgccgtatagaggtagttttctcttgcaatccgccgtcgaaaggagtatgatacaaatagtatcaaaataaaactaaaaagttcaaggaggagacgatatgggtaagtttgacggcagagtagcgattatcaccggcggcggcaagggcggcggcatcggctacggcctgtccaccgccttcgccaaggagggctgcaatctggtcatcaccggccggaacaccaagaagctggacgacgccaaggaggagctggagcggctctacggcgtgaaggtgctggcctgccaggccgatggcggcgtggaggagcaggtggcggccgtggtgaagcaggcggcggacaccttgggccgcatcgactttttgatcaacaacgcccagaactcggcctccggcgtccccctggccgagcacaccaaggagcagtttgaccaggccatctactccggcctgtacgccgccttcttctatatgaagcactgctacccctacctgaaggagacgaagggctccgtggtcaacttcgcctccggcgcgggcctgttcggcaagcccggccagtcctcctacgccgcagccaaggagggcatccggggcatgacccgtgtggccgccaccgagtggggccccgacggcatcaactgcaacctcatttgccccctggtgatgaccgacgccctcaagaagtggcgggaggagtatccggcggtatacgagcagaccatcaagggcatccccgccggtcgcttcggcgacccggagaaggacatcggccgcaccgctgtgttcctgtgctcagaggatgccaagtatatctccggtgagaccatcaccatgcagggcggcagcggtctgcgtccctgacacatccaaacagaggcgcgcctgagatcaggcgcgcctctgtttttccctggcaaagcggtaggcctcggccagccaggccgccagcagcccgtccacatcctccggtgcggtcaggagcagatggtgggtccagcggccgggatagggctccacggcctggaggatgcgggggtgctccacccggcggcccagccccagggtggccagcagagccccggtccgccgctgggcggcccgccggggctgggagagaacggcaaactgaagggggtttccccaggaaatctgggttttggacaccttcatggtgctctccccgcaggccaggacggcctcctcccatgcctcaaagagggaaatggggcccggagcgcctcccaggaaggccagcacttcggcggtcatgtctgcgcctcccccagaaccgagtggttccaccggccggtgcggaagtagaggagctggaggagcacctggatggcggaggccgccggcgcggccacaccgatgtgcagcagagtgacaccggggagcaggctgatgaaaaataccgccggtacccgtaccaggaaggtggatgccaaactgttgaacagggtgaagccggtgcggccgcagccgctgtaaaaaccgttgagggtgaacacaaaggtgaccagaatgcagtcgatgctgtaggtgcgcaggtagagcaccccgtggtagatcacctcggcatcgggggtgaacagccgcatggccagccccgggacaagctgaaccaggacaaacatggcgatgtcggccgccagacaaaacaggataccgtatttcagcccctgccgggcccggtcggggcggcccgcacccatattctgggcggtcatggcggaaatagccgactggaaggcgatggggaagagcatgataaagccggtgatgcgctctaccaggcccacagcggcggattgggccagaacatccatgtggtttacaatggcggtgatgataagaaaagagagggtaaccagcacattctgcaccgccacaggcaggcccaggcggaggatgcgggccgccttgtccccctgaatccgaaaggaacgccgcttaaaatcaaaggggaagtcccggtggcggagtaccgccagggccagggccaggctcaccccctgggcagccacggtggcgagggcggcccccgccgcccccaggccgaacactcccaccagcagaagatcccccacgatgttgatgatgcaggccaccagcacgaagtacatgggccgcttggagtcccccaggccccggagcacgccgctgaccatattgtagccggtgatgaacaccaggccgcaggcgcagataaacaggtactgccgggcgggcgccaccgccgcggcgggcacctgcatcagcgccacaatggcgttggtggacagggcgaaggcggccgccaggaccacggcgatgagggaaaagagggaaaacagggtgccgatggcccggtttacgtcctccccccgccgggcgcccaggtactgccccaccagcaccgtaccgccggtggacaggccgataataaaattggtcaccgcctgcatgacctggctgccggtggacacggcggcgatgcccgcctggtcggcaaactgtcccaccacgatcaggtccaccgcgccgtacagaaattgcagcagggaagcaccgaggaaggggatggcaaagcggcttaacgcccgcctgacatttccctcggtgagagagagctgggacatggcggtacactcctttttgtttcgtacccggacagtatagcacgcccccggcggaaagacaacctttgacgggccgggcggcgggtgttatactgggcacagtcaacccaaaaagaaaggcagatgtgaccttgagcgcgcatgtttccatcgcccatcccgcgtggatggatatcaccggccctgacggggccgtgacccacggggcggatcaggactggtttcccgatctgtggcagcagcgggcgggctgtggacccaccgccgccgccgtcatcctctcctatctggcccggacccggccggagctggcccccctctacccggagggggccatggaccgcgcctccttcaccggcctgatgtgccgggtgtgggagcacgtgacccctgtttcccacggtctcaaccggccggagcagatggcggagggcatggcctcctttgccgccgcccggggcctcactctgacccccggcctgttcgtattcccctccgcccgcaccaagcgcccgccctatgagcaggtcgaggcctttgtccgccgcgccctggagcgggactgtcccgtggccttcctcaacctccacaacggcagggtgaaggagctggattactggcactgggtcaccatcaccgctctggaggacaccacggcggtcattctggacagcggcagcgcactgcgcatcgatctaaggctctggtacgagaccaccaagcggcggggcggctttgtggccgccctgggggacccggcatgaagtattttctgctctgggtgttgtgcgccagcctcctggactttgccctcatgggtgtggacaagtggaaggccaggcacgaccgctggcgggtgcccgagagggccttcttctgcgtagccctgctgggcggcacgccgggggccctcctgggcatgtggaccttccggcacaagacccgccactggtatttcaggtacggcctgcccgccctgctgctggtgcagctcgccctgggcacgtggattgcgatacgtgttttttgacctccgatgtgccggaaaggccgcccctccgttgggaggggcggccttttttcacggctttttccccagcttatgcttggtgccgtcgggctccacgatataggtgttttccaactggctcaccaggctggcccggtaggcggcgatatactcctgccgcagccggtcccgctccgccgtctcctccggggtgaggccctcagggcttttggcctttttggccagggcattgatccggtcgatttttgcctgttccattatacataccgctccaatacgatgagaatacgcccctttttggacgggccgcccacctctgtgagcacgcacttgcccagcccccggcagctcagcacgtccccctgggccacggcgtggtcgggcttgacacattcccggtggttgagctgtacccggccggaggagatcaggtcggcggccttgccccgggacagggagaagccggaggcggccaccgcgtccagccgcagggagcttacggtgtcccggatggttctggtctccaccgccgggggctccagccggtccaggggcagaggggaacacttgagttttacacgccccgcctgctccatgtggaacaccagaaagtcggcgacctcctccagcgccagcacgtcgcagcgcccgtcgcccaccagcagatcccccaccttctcccggtccaggcccaggccaaggatggagccgaggaaatcccggtgggtaagcttttggccgccgctccaggtgcaccgcagggcgcggacgggacagctctccccgtccccctgccagtcctccgcctcctgccagtcgggcaggaaggcgcatacggtgcgctccgctccctcgtacccgccgaagaagaggtggcggggatggccgcaggtattgagcaggttttccacactcgcccgctcctgtggggataaaaagccggtgcaggccggtatgttccgctgccgggccagctccagcttgtccagcgcccgggccaggagcagccgctccccgttgtcccgggccagcttattcagcagttccgttttattcacacatacttcctcgcttgtggaaaaagggcgccccgacgggcgccctttccatttgtcataactgtctccgcaaagcgccgctctctctgagtcagcggtgctcgccccggctgtacgccaccaccgtgcggcggttgggctcagtgccgatggagtaggtggtgatgtccggggtctcctggagggcggtgtggatcacatggcgctcataggcgttcatgggctccagggtgacgttgcggcggtatttgaccaccttaccggccaccttctgggccaggcggaccagggactcctcccgcttggcccggtagccctcggcgtccacatgaatacggacccgcttggactggccgtggttgacggcgtagccggtgagctgctggatggcgtccagagtctcgccccggcggccgatcaggccgcccagctcccggcccaccagctccacctgataggttccgttttcatccatccggatgacgggtctggcctcggcccccatctggaccagcaggccggtgagaaaggcgtcgatgcgctccgccttctccccctcggccactggggcggcgggggagggggcctcctcccggacggcgggctccgccgccttgaccagctccgcctcggcaggggtaacttccgccggagcggggcgctcctccggctcgtcgggggcctcatagctcaccttgaccttggccgggcagctcccgatgcctaaaaatccggacttggcccgctccagaatctccacggagacctcatcccggtccatgcccagcttctgcagggcggcctcgatggcggcctcctcgctcttgccggtgctctcgatccatttcagcataatgggcatctctccttatgaatccacggcagggccgttattcctttgtcttgtcggtgtcgtcctcagcctcggactcctcggcgtagggggcctcggactcctccccggcggagacaacctccgtctcctcctggacaggggcctccagggccttttcctccaaaatggcgtcctcaatggcctcgtcggtgtggatctcccgcagctcctcctcgatctcatgggcctcccgcttcagcgcgcgggagtcagatctgggcgggaagatgggggcctctccggggtaggcggtgggaccctcctcgctgtagcggtaggggtcgtaggcccgtccgcgggcatactggcgcaggcccacgcggctgtgctccttgacggagccggggatcttgtcctcgtcctcgtcgtgcttcttctcggtcttctttttcttgcccttgttgagcttggcctcctcgatccggcgggcgcgctcctcggccttgcggcggcgctcctccttctcctcctccttctccaggcgctcctgctcggcccgggcggcggcggccttctcgtagtcctttttgagcagcttgccgcagatgaactcctgcaccatgctcagcaggttctgggcaatccagtacagacacagggcggcgggcatggagaagccgatccacagggaaatcaggggggaaataatcatcatggacttcatgctggcgttgttccccgcctgggcggcctgttggttgacggcgttggtcttcatggagatgaaggaaaacaccaggctggagccggcggacaccacgggcagcaggaacagggcgaagccgcccgccacggtccagaatttcagagttggaatacgggccagatccaccaggcccaggaaatcaaagttgacggcgaaaatccggctgcccacctcgcccacagcggccttgaccgcctccaggttttccggggtgatcagggaggacaggtaaagctggttatagcccacattggagaaagcttcgccggcctccttgatccagccgttgctcaccgcaatggagttccagtccaccacctgggcaatctggttgagtatctccacatcgttgatgcccatcatatacttgatgggctggcggatgatggcgtacaggggaatcagaatcagcagagggagaaaagaccacaggcagccgcccatggggttgaccttctcccgctcataaagcttctggacctccagattatagcgctcacggtctctgccgtactgcttctgcagcttctgcatcttgccctgaagcatgttcatctgaatcatgctccgcttgcccttcagcgcaaacgggaacaggataagcttgacaacgaccgcgaataagatcaatgcgatgccgtaactgccgaaaaaattgtaaaagaaggtcagcagccacacaaagggggagaggataatctgtgcaaaatccatttgcgcgcctccaagttcagtttgagccccttacgggaccggatcgtactcaatggaaacctgcttgtggaagggctgacatttgaggatacggcgcagggcgagaaagccccccttccacgccccgtatttctccaccgcctccagggcataggccgagcaggtggggataaaccggcagcaggggggacgggagggagagatgtacgtgcggtagccccggatcaaggccagaagcaggcgcttcaatcaggccccctccttccggagcaggccgagcttgtccgccagagacaggagcgagcgctccaactcccggtaacggctgtgggcggcccgcacccgggccaccaccacgatgtcgtagccggggagaaaggccccctcatggatgcggtaggcctctttgattcggcggcgggtgcggttgcgcaccacggccttgcccagcttgactcccaccgtcaggcccaggcggctgtagcccaggttgttcttccggcagtagacggccaggcacggattcaccgcgctctttccccttccgtacaggcggcggaacacgtgattgagtttcagcgaaacggtgtgctccacgcctgccgcctcctcgatttctccgtatgctacgcaggggcggtgggaaaactcccccgccccttctgaaagccctattccattcgcggacccattagtgggtcagacgggcgcggcccttcgcgcggcggcgagccaggaccttgcggccgttggcggtacgcatacgcttacggaacccgtgctccttggagcgctggcgcttcttgggctgataggtacggaccatgtcggtacacctcctgtactgtaatccggcggcagggccgcccaccacaacagccttccggctgcggtcgtcaaagtaaactgctttacaccgtgcaggcctgcacgatgcagatgatattatagcctatctcaaaatagcctgtcaacaccatttttgcaatcttttttgcggtttgggcctgcttccgctccgggtactacatcttgtgcccattgggcccgcctcggccaacactcacccgtaggggcggggcttttccccgcccgcctctttcctcctcacccaaacctcccgccagacgggcggccacaagggccgcccctacgcagaagcgcggagggtaggcgcataggggagctaagaggccatagaggtaaaaaccaagccgggcggagcccggcgacatttccggcgcaccgcagtccggggtggcgttgcccaggcaagtacagcgcacatgccgccaaattgggtgggtaatccgccggggccgtcaggcaaagcatcgacacgcgccggccgatacgggccgcaaccgccttcaagtcttgtcgccatcgtacaacgtaccgccgcccggctccatggggttccggggccgcagcccccagtcccaagcaggtaacggggaagcagcgccgatcccggcccggtggaaaaatcttcgaaaaaagagattctttttttagtagtatacgttgcttttaaggcaattttttggtataataaagtgctattgatattttccgaaagaggtggtctttccgtgaatttcccggccgatatctggcccaaggtgctctccctcatggagggggatatgaccgccaccacgatcaacacctggtttgacgacgccacccccgtggcgctggacgccaaccggtttgtgctccacaccccctccaactttaagcgggacatcatcatggcccgctatctgcccgtgatccagaaggcgctccacgagctcttctccgccgacttcgaggtggtagtcctgggagagggcgagctggaggatttcggcaagaaaaaaaccgacgatgtctttctgccgggcaccgaggagtacacctttgagcggttcgtggtgggcgcgtccaacaaattcgcccacgcggcggcccaggcggtggccgagcggcccgcccagacctacaaccccctgtttatctacggcgagtccggcctgggcaagacccacctgctgtacgccatcgcccacaagatccaccagaaccacccggactaccggatcgtctatattaagggcgactccttcaccaacgagctcatccaggccatccgtgaggggcgcaaccccgaattccgggagaagtaccgctcggcggatgtattcctcatggacgacgtgcagttcattgccggccgcgagtccacccaggaggagatgtttcacaccttcaacaccctgtacgaagcgggccgacagatcgtgttcaccgccgaccggccgcccaaagagatgctgcggctggacgaccggctgcgcacccggtttgaatggggcctgcccgtggacatccagccccccgactacgagacccgggtagccatcatcaaaaacaaggccatccggcgcggcatgaacctgcccgacccggtgctccagtatatcgcggagaacatcacctccaacgtgcggcagatcgagggcacggtcaacaaaatcctcgccttccaggagctgatgggggagagcgtggacgtggacaccgtaacccgggcggtgcgggacatgttcaaggacaaggccgacttcctgccctcgccggacatcatcatcgacgaggtgagcaagttctacaacatcgacgccgacgccctccgggggcagggccgcaccaaggacaccgccctggcccggcagatcgccatgtaccagatccgccgcatgaccaacctctccctcaaggagatcggcaaggagttcgaaggccgcgaccacaccaccgtcatgcactccattgaccgaatcgagaagctgaccaaaaccaacccggagattgccgaggttatcaaggacatcaacgccaacatcaatgcccgctacgaataattgaccgttctgtccacatttccacggtattttgtgaagatgtggacaaccctgtgtggaaaaatccatcccttcgtcctcatcggtggaaaggcgacaaaaacatccccatcccctgtggaaacgggatcccttcccccccagcggattccgccgtttttccacatcattttcccctacggcttactattacgatctcactctcccctttctccggggattcacgcacactcactacaaaatggaggtcaccaatcatgaaattttcctgcgaaaaagctctgctacaggccgccatctctaccacatccagagcagtatctcccaaaagctccattcccgctctggaagggattctgctggaggccggcagcgacctccgcctcaccggctacaacctggagactggcatccgcaccattgtccctgccgacatccgggaggaaggcactctggtgctgggcgcacgcctgtttggtgaaattgtccgcaagctgcccgacgacatcgtcacctttcaatcagaaaactatatggtcaacatcaaatgcggcatgagcgaattcaacattctgggcaccgatccggaagaattccccgagctgcccaccgtagaataccaaaattccctgattctgccgcaatccaggctaaaagccatgattagtcagacccttttcgccgtcagcgacaacgagatccgccccatccacaccggttccctgtttgaagtggacagcaacggtctcaccatcgtatcagtggacggctatcgcctggccctccgccacgaggccatcgacaagaaggagggaacggagaccttctccttcgtagtgcccggcgcggccctgtccgaagtggaaaaaatttgcagcgacgtggacgagccagcctccgtcacccagggcgcccgccacgtgatgttcaaggtgggggacaccatgttggtgtcccgccgactggagggcgaatttctggcctaccggcaggccatcccccgcaacaacaccatccacgtggagggggacacccgcgccctgctctcctccatcgaccgcgtgtccctcatcatcagcgacaagctgaaaagtcccctgcgctgcgtatttgacagcaatctgctgaaaatctccaccaaaaccgccatcggcgacgcctatgacgagtgccccctcagcggcgacggcggcgggctggaaatcggcttcaacaacaagtacctgatggacgccctcaaggccgccccggcggacaaggtgcggctggagctgaccaccggcgtgtccccctgcgtcatcctgcccaccgagggggaggagaacttcctctacatggtgcttcccgtgcggctgaaggcgggcgagtgagcatggagatcaagccctacctccgccggccccagttctacgagaccgacggcatgagcatcatctggcacggcaattacgtccgctggatggaggaggcccgcaccgattttatggatcagctcggcttcccctacgccagggcggtggaggcgggcatcgacttcgccctgacggacatttcctgcaaataccgggccatgacccgcttcggcgaggagctggccatcacggtatccatccgccgcctgtccccggccaagctggagctaggctacgagatgcgggaggcgtccaccggggagctgaaggcggagggcacctccggccacttcttctatgaccgggccaagggccggccggtggcgctgaaaaaggccctgccggaggtctaccggctgctggaggccctcaccacccctgactgagagaggaatgaactatggaacaacggcaggtcaaaatcaccacggaattcatcaagctggacgccctgctcaagttcgagggactggcgggcaccggcggggaggccaaggagcgcatacaggacggcgaggtgctggtcaacggcgagacctgcaccctgcggggccggaaaatccgccccggcgacaccgtttcgctggacggcgtgacactgaaagtggtatgattgtccgctccattgccctggatttttttcgcaactacgtccaccttgacgcccgtttttccccggaggtcaacgtcatctacggcgagaacgcccagggaaagaccaatctgctggaggcggtggcctatctgtccaccgcctcctcccaccgggcccggtacgaccgggagctcatccagttcggcgtggaccatgcttttgtgaaggcggaggtatccgcccgtgggcgggacttcaccctggaggcccgtctgggccggggggtgcggcggcagctctactccaacggggtgcgcctcaagtccgccggggagctgtccggcgtgctcaacaccgtgctcttctgcccggaggacctctacctcatccgggagggagcggctacccggcggcgcttcctggacgggtgtatctgccagctccggcccaagtacgccgaggccctggcggagtaccgccgcctctacgagcataaggtccgcatactccgggactgggaggagcacccctccctgctggacaccctggacgagttcaacctgcgcatggcccagaccggggccctgctgatccactaccgggcccacttcgtcaagcgcctgcgggaggtgacgccccccatccatctggacttttccggtgggcgggaggagcttggcctggcctatgagacggtatccaccgtcaccgacccggaggacagcccccggagcatcctcccccagctcctggcccatcaggagagccaccggaaggcggagctggagtcccgccagtgcctctccggcccccacaaggacgatctcaccgtggagctgaacggcatgagcgccaagaccttcgcctcccaggggcagacccgcaccgcggcgctgtccctcaagctggcctcccgggagatcttttatcaggagaccggcgagtggccggtgctgctgctggacgatgtgctcagcgagctggacgcccggcggcaggagttcgtgctccggcgcatcaacggcgggcaggtgttcatcacctgctgcgaggacgcccggctggaggggctggaggaggggaaggtcttccacattcacggcggggcgctgaagccataggggaaggtgtccgtaccccctgcccatatagggcgggataacggcggcccgtgcaatccttcattccacacatggacgcatccaaggagaagcatatgcccattattatcggtatcttttgtgcgctgccctttctggcggggctgattgcagaatatctggtgtgccggctgacccggcggcgttggtggaagctgcttcccccggcggcggccgtcgcgctgacggctgcggtggctgtggggcgggccggagtttgggagtccgaccagtctccgctgacccaactgctctttgtgccgggattgccggcgctgtttgcccttctgggcctgctggcgggctggcggctgtggaaacggctgtggggcccgcgggtggtgaaggataagggggctcgctgaatgtatctgcatctgggccagggcgttgtggtaccctaccgggacgtgctcgccctctttgatctggacaacaccagcgcctcccacctgacccgcaggttcctggagcgggccgagcaggccgggcaggtagtcaatgtggccgaggatctgcccaagtcgtttgtcctctgccgcccggcgggcggggaggccaccgtctatctctcccagttgtccaccgccacgctgctccggcgggcggagaacaacagcttcgaataaacaatccaaacgggccgccggaggcggctcctgcggcggggccgcaggggcggcccctggccgcccggatatcccaatggaggttttcaaatgtctgaagaattcgagaacagcactacccaggtggagcacgagtacggcggctctgagatccaggtgctggagggcctggaggccgtccgcaagcgccccggcatgtatatcggctccacgtcggagagcggcctgcaccacctggtgtacgagatcgtggacaactccatcgacgaggccctggccggctactgcgacgagattaccgtcaagatcggagagggggacatcatcaccgtcatcgacaacggccgcggcattcccgtggatatccagccccagaccggcctgcccgccctggaggtggtgttcacgatcctccacgccggcggcaaattcggcggcggcggctataaggtgtccggcggcctccacggtgtgggtgccagcgtggtcaacgccctgtccgagtggctggaagtgcgggttcacaaggagggcaaggtctacgagatgaagttctcccggggcaaggtgacccagcccatgcaggtggtgggggacaccggccgccacggcaccgaggtggtgttcaagcccgaccccgagatgtttgagatcaccgagtacagctacgacaccctccacacccgcatgcgggaggaggccttcctcaacgccggactgaaaattcataccattgatgagcgccccggtcgggagcaggaggacaccatgcactacgccggcggcatccgggagtttgtgtccttcctcaaccagtccaaggacccggtccaccccgatgtggtctacatggcgggacagaaggacgacgccatggcggaggtggccttccagtacaacgacgggtacagcgagaacatcgtctccttcgccaacaacgtccacaccccggagggcggcatgcacgaggagggcttcaagcgggccctgaccacggtgctcaataattacggcaagaagatgaagattctcaaggacgatgacaaggtatccggcgaagactgccgggagggcatcgcctgcgtcatttccgtcaagctgaccgaggcccagttcgagggccagaccaaggccaagctgggcaacagcgagatccgcaccctggtcaacaacattgtcaccgacaagctctccgagtatttggaggagaacccggcggtgggccgcgccattctggacaaggccctcatggccaaccgggcccgggaggccgcccgcaaggcccgcgagtccatccgccgcaagaccgccctgggcggagccgctatgccggacaagctgcgggactgcaacgaggtcaacccggagctcaccgagctctacatcgtcgagggcgactccgccggcggctcggccacccagggccgggactcccgcttccaggccatcctccccctgtggggcaagatgctcaacgtggagaaggcccgggccgacaaggtatacggcaacgacaagctcacccccgtcatcaccgccttgggcgcgggcattggggacgacttcgatctggagaagctgcgctaccacaaggtcatcatcatggccgatgccgacgtggacggctcccacatccgcacgctcctgctcaccttctttttccgcttcatgcggcccctcattgagcatggctatgtctacgccgccgtgccccccctgttcaagctcagccgcggcaagaccacccgcctggccttctccgaggaggagcgggacgccatctccgccgagctgcggggggacaatcccaacgccaaggtggacatctcccggttcaagggcctgggtgagatgaacccccatgagctgtgggaaaccaccatggacccggagcggcgcaccctcaagcgcatcgagctggacgacgctgtccgggccgaccagaccttcaccgtcctcatgggggagaaggtggagccccgcaaggagttcatcgagcgcaacgccaagtacgccgtcaacctggactattaagggattggggaacggacaacgtgcccggaacgcgtatcgtaggggccgatgcccacatcggcccgacgttccggtgccgcccaggcaacaaaaacgggcggatgaaggcatccgcccctacaaaggaaaaaatcgccgggaacagcgaaacgcccacccgcaatttgtgggggcggcccttgcggccgcccgccgtgaaccaccctatcacgaagattgtgaggcagatacatgagtaaaaagccacagtatgatccggaggaaatccggtttccagaccagaagatagagacctcctatctggtgcacgagatggagcagagctacatcgagtacgctatgagcgtcatcgtgggccgggcgctgcccgacgtgcgggacggcctgaagccggtccaccggcgcattctctacgccatgtatgaggacaacctgaccgcggacaagcccttcaagaagtcggccacctgcgtgggcgacgtgctgggccgctaccacccccatggcgacgcttcggtgtacgacgccctggtgcgcctggcccaggatttctccatgcgctaccctctggtggacggccacggcaacttcggctccatcgacggcgatcccccggccgcctaccgttacaccgaggcccgcatggccaagatctccgacgaaatgctgcgggagatcgagaaggacacggtggactgggacccgaacttcgacgagagccggaaggaaccccgggtactgccctcccggttccccaatctgctggtcaacggctcctccggcatcgccgtgggcatggccaccaatattccgccccacaacctgcgggaagtaatcaatgccacgatctgcgtgctggacaacccggaggcggagctgtccgacctgatggagcacgtgaagggccccgacttccccaccagggggatcatcatgggccgctccggcatccgggcggcctacgccaccggccggggccgggtgtgcgtccgggcccgcatcgagtttgaggagttcggcaacaaccgcacccgcatcatcgtcaccgaaatcccctaccaggtcaacaagcgcatgctcatcaagaacatggccgaccaggtggaggacaagcggctggagggcatctccgacatccgggatgagtccgaccgcaacggcatgcgggtggtcatcgagctcaagcgggacgccaatccccaggtggtgctcaaccgcctgtttgcacagacccagctccagaccaccttcgccatcaatatgctggccctggtgcagtccggcggccagccccagcccaagatcctctccctgcgccacatcctggacgagtacatcgccttccaggaggaggtcatcgtccgccgcacccgctacgatctgcgcaaggcccaggagcgggcccatctgctggagggcctgctgattgccgaggacaacatcgacgcggtgatccagaccatccgggagagctacgacgacgccaaggagaacctgatgaaccgcttcggcctcagcgacgtgcaggcccaggccatcctggacatgcagctcaagcggctccaggggctggagaaggagaagctgcagaacgaatacaaggagctggaggcgcgcatcgcctacttcaatgagctgctctccagtgaggagaagatccgcggcgtgctcaaggacgagctcaccgccatccgggacaggtacggtgacgaccgggtgaccgagatccaggacgtggaggacgagatcgacatcgaggatctcatcgaggaggaggagtgcgtctttaccctcaccgccggcggctacatcaagcgcaccgccgcctccacctacaaggcccagcgccggggcggcaagggcattaccgccatgtccaccaaggaggaggactatgtggacaccgtgttcaccgcctccacccacgatttcattctctttttcaccaacaagggcagggtccaccgcaagaagggctatcagatccccgaggcgggccgcaccgcccggggcaccaacctggtcaatgtgctgcccatcgagcaggatgaaaaggtcaccgccatgatccacctgcgggaattccccgaggaccgctatctggtaatggtcacccgcagcggcaccgtcaagcgcatccagctctcctccatctacaccgcccgcaaggcgggcatccgctgcatcaccctggacgagggggatgagctcatctgcgtgcgggagaccgacggcgaccaggccatcctgatcgtcacccacgacggcatggccatctgcttcaaggagaccgacgtgcgctgcatgggtcgggacgccgccggcgtccggggcatcaacctacgccccggcgactacgtggtgggggccgcccgggccaagcgggaccaccaggtgctgatgatcaccgaaaacggctacggcaagcgcaccgacatggacgagtatatccgcgccgacgggccccagaagcggggcggatttggcctgaagggctataatgtcaccgagaaaaccggtccagtggtgggggtcaaggtggtcagcgacggggacgacgtgctggtgatcaacgatgccggcgtgatcatccgcatggcggccgccggcatctccacctacggccgcaccgcgcagggcgtcaagatcatgaatttggaggagggggtcaaggtgatctccttcgcccgtaccgaccacgaggaggaagaggaggccgctgagggggattcccctgccgttggtacagaggaggaataagccatgcgccgcagacgcgtcacttaccgacccagcaagagccaggccgtgtttggcggcgtggttggcatcatctttgtatgcatcggcctgtttttggtcattcccacgtttggactgttcggtattctgtggaccctcatcgccgccggtatcaccggtatgaacttttatcaggccttcggtaggggctatgtggggccagaaattcatatagaggatgaaaacggtgaaaaaagcggcggccttgaggaacgcctacgtcaactccagaccctctacgaacagggattgatcacccaggaggagtacgaccagaagcggcgggccatcctggaggatttgtaaaagggtctctccttccgctgtccatgacccgaggaggaatccctctgtccaggcggatcaataaggccttcccctggggggaaggtgccccgcaggggcggatgaggggaaggtggggcgacatacagggtgagaaagcgccgtgcgcctttgcgcagcggcttcggaaacatgccacgagagaggaaaatcatctttggtatgactttctgcgggcgtatccggtcccattccaccggcaaaaggtatttggcccctatattgtggatttttaccgccataaagccaggcttgttgtagagctggacggcgggcagcattatgagcgtgagagacagaaggcggatctcacacaaaccgggtagttgcgggatgtgtggaagctcaatgttctgcgctttccaaatacggagatcaaaggaaattttgaaggtgtgtgtaaagccgttcacttggcggttgaaggggcgttcccctcatccgtcacggctgcgccgtgccaccttcccgcaggggaaggccataggagatttatgaagacagttaccatttataccgacggggcgtgctcgggcaatcccggccccggcgggtggggggctatcctgcaatacggagagttccgcaaggagctctctggcggggaggcccacaccaccaacaaccgcatggagctgaccggggtgattacggcgctggaggcgctgaaggagccctgtgaggtggagctctactccgactccaagtacgtcattgacgccctgcagaagggctgggccaagggctggagggcccgtgggtggatcaagtcggacaagaagccggccctcaaccctgacctgtgggagcggcttctcgcgctgtgcgagcgccacaccgtccgtctccactgggtcaagggccacgcggataatccccataataaccgctgtgacgagctggcggttgcggagagcagaaaatataaataagcccttggggccccgctctagcggggcggcgcttgcgccgtacataacacttcatgtgcacagggcgcgccacgaaacggtgcaaaggctcaggcgcatgaagtgtttgtgcatgtgggccgtaccggcctacgcgctgtcatcccatggccgtgccgctgtaagcgggcgtatggccaattctgcgatgcttttgcatagcaaataaagcggggcttccgccagttggggatcaatcccgccggacagcgtattgcgttattgccaccgcagggacggcccttgtggccgcccgccgtttttcagaggaggacatgatgaaaattgccattgtatacgccagcgagacgggcaacaccgcccagattgcccaggccatccgcgagggatgtcagggccatgagattgtggccttcggcccgctgccccgggacgtgggggaggcgaagctgatctttgtgggctcctggacggacaagggcacctgtgccccggcggtaaaggagtttttgcagggactccacgggaagcgggtggccctgttcggcacggcgggttttggcctgtctgagatgtattttgcctctctctccgaccggttccgggcggaggtgccggaggaaaatcaggtgttgggtacctggttctgtccggggcggatgccccctgccgtccgggctcggtatgaggctcagctcaaggagaagcccggcgacgcccggctggagaacatgctccgggcctatgaccaggccctgtcccaccccgacgggacggacctggcggatgcgcgggcctttgctgccgcgatgctggccaaataaaaaggagctccgccatatggcggagctcctttttgcatttaaagggtgcggatgggacggcaggggttgccgacggccacaaccccctctggaatgtcgtggaccaccacgctgcccccgccgatgacggcgcggctgccgatggtgacgccgggcagaaccgtgacacccccgccgatccaaacgctgtcccccacggtgatgggcttggcgtactccagctcctcgtcccgaagggtgtggtccagggggtgggcggcggtgtagaagccgcagttgggggccaccatgacgttgtcgccgaaggtgatgggggcgcagtccagcatcacgcagttgtagttgcagaagaagttctcgccgatggtgatgtgccggccgtagtcgcaccagaaggtggatttgatggtgaagtgttcgccggtccggcccagaagctgccgcagcagggcgcgggcctcctccttctgattggggttgagctggttgagggcgtggcagagctccatggccgtccggtgcatggcctggagctcgccgtcctgggcgttgtagagctggccgcccagcattttctgatattccgtcatagcaaatcacctcaaacaaacgggcgggcgcatacagcgcccacccgtctcatgccggtcaggattccggtttcgggccctggggcctgtcgcccttgggcttgccccggtagcggcggcggtgggggcgcttcttctcaccggtgggaggggccgctgctccgtcggaggccgggggtggtgcggcggacgccttgggctgcttttccggccggggcggacgctgctgctcccccttttgcttctgcctggggggctgagtctgcctgccctcctcggcgggctttttggcggcgggctcggcggacggcctgctcccgccccggccccggcggccccggccgcgggagcggcgctccccgccctcggcgggcttctccggctcggcgggggcgacgcccaggccgctgagggcggcgtccacactgccggacaggcggtggggctcctccacaggggtgatcttacgcagcttggccagctcctccgggggagggggcacatagccctcgggcagtttccccttgccgttgcggaccacgcagatctcgcagttgtggaaacacttgggggcctcgggctgctcctccagccgtaccttcacggtctccttgagcaggttgacctgagatacggtgcccaccccctccggggtctccacaaaggactcgttcttgggcatacggcgcaccgcgtcctcataggcctcctgctcgtatttcaggcagcacatgagccgtccgcaggtgcccgaaatcttggtggggttgagggacaggttctgggttttggccatcttgatggacaccggctgaaactcgtccaggaaggtggcgcagcagaagggcttgccgcagatgcccaggccgcccagcattttggcctcgtcccggacgccgatctgccgcagctcaatgcgggcgtggaataccccagccagatccttgaccagagcgcggaagtccacccgcccctcggaggtgaagaaaaagaggatcttgttcccctcaaagttgtactccacctccaccagcttcatatccaggccatgggcggcgatcttctcctggcagatggaaaaggcccgcgcttccttctcacggttcttcgccacggtgtccagatccttctgggtggccaggcggaccagggggcgcagcggctgtaccaccgcctcgtcctccaccatggtgttgccctgggtacactcgccgtactccaggccgcgggaggtctcgataatgaccccctgaccgggggccacggcctgtccattggggtcaaaataatactgtttgcctccgcttttgaagcggacgccgatgatttcggtcatgattacctccgcatcaggtgtatgggcgggggcgggcccgcccggtcatagggtgctcagtgccgcccccagccagccggccaggtgcccggcccccacattggagccgcaggcggcgcgcagccgctccagcacgcccaccgcctgggtgagctgccggggggagagggcgcgggcggcgcgctccgccgcctcacgccggcgggggtcggactcccgcagggttccggcggagcagacgagggcatcccgcagcaggagaacgccctcgtccagcagggcgcgcagctgctcccggtcccacttctccagggccacgcagtgctccagcagggccagctcgtcaccgccgtccaggcggcgcaccagctccagcgcgccgtccagggcctgggtgtcgcctgcggcctgtccctccagctcggcggctgcccggccaagcaggccctcgcagcggtcggcggcggcctgccgggccgcctggggctggtcggggtagtgctcgtccagccagagctccgcctcccgctgggtgacgggggagagggggagatgctcacaccgggagcgcactgtgggcagcagggcggcggcgttatcggtgagcaggagaaaggcggcgtaggccgggccctcctccagaagcttgagcatggcgttctgggcgctggcgttcatggtctgggcgttctccaggatgtagaccttgcgttcggcctcgttgggccggatgtaggcgtcggcgcggagggcgcgcacctgggccacgctgatatccttcccgtcgtcccccacccgcacgatgtcggggtggatgcccccctccgccttgcggcagccggcgcaggacagacagggcaaagcgccgccccggcggtcgcacaccagggcggcggccagcaggcccgccagggtccgcttgccggagcccgccgggccgctgaggatgtacgcgtgggagaggccccgccgggccgtctccagctccagctgccgcttcagcggggcgttgcccgccagccgggtcaggttcataaagactcagacccgctcaaaccgctcgatatccaccacgaagatggtggcgccgcccaccacgacctccacgggcatggaggggtagtagccgtagctcatctcggtggtggtggggatcatttgcttgcggctgtgggaatgctcccggatgatgtcgatgacggtctgcaccttctcctcgtccacgccgatgagaatggtcacgttgcccgccatcagaaagccgccggtggtggccagcttggtggaggagaagcccttcttggtcagggcctgggtgacggtgttggcgtcatcgtgattgataatcgcaagaatcagtttcattgcttttccctcctgaaggaaagacgctcctttgctcattctatgaggcacacacaggttcggaaacaacctcaacgtcttccagtgtattataacctatttgtttcaaataagcgatagtttttttgcaaattcgctccccaggcgcgaaaataggtaccccggggggatagggggccacctgctgggcgcagatgcgtccctccgcggcggacagggggagggaaatccggggggaaaagagggcctgacggggggtgagaaccgcctccggcgggggcggaggcgggggcaggggagcgccgtccccccacgccaccgcgtccagggcggcccggagccggataaagtcctcctccgtgtcggcgcaggtggggatgaacaccacatggcccgcgtcggccatctcgggccacacccccatcccctccagggccgcctgggcggcaaagccgtcgggggcgcggagcaccagccgggcagggtccagcgccgggccggacacgctggggtagtcccgccgcagggcggccacctgccgggcggcggcccggtaagcggcggcgccctcctcctccatccacgcccggcagagatccaggcaggccatcatgggataggaggggctggaggagccgtaaagggtggcggcccgccgcagttcggcgtggggaaaccgttccccggccaacagcagggcgctctgccccagggcggggagggtcttgtgggccgatgtcaccgccagatcggcggcggagaggtggtcatttcccaggaacggcagatgggccccgtgggctccgtccaccaccagcaccccgccccgccggtgcatcagctccgccagggcgggaagatctgacaacattccgtagtaagtgggtgaggttatacagagcgtctttgcgtccgggtattcctccagagcctgggccaccgccgagggggagatggggccggtgatcccctccgaggcaagccagggccgctccagatagaccggcttcaggtccagcagggccagggcgttgtaggcggagcggtggctcccccggtccagcagcaccgtctcccccggtttgcaggccagggccagggcggcatgaaccccctgggtggagccgccggtgagaaacaggcaggaggccatgtggaaaacctccgcccagagggcctccgccgccccgatggccccgcccccggagaagagatcccccgtggggggtagctcggtgaagtcaatggccgcaatggccgccagctccggcgcaggcagggggttacccttatggccgggcatgtgcatccgcaggggccgctgggcggcaaaggcccgcagagcgtcgtacaggggggtggatcccacaaaaaacgcctccagtgtggaaaagttggtttgagtatagcagaatccgggcggggacacaagtgggagcggacctcgtagccgcctgtccgaagcctgaggcgggaacaaaagaggtgggcgggtgtgggcacccgcccctacgtgtgagcgttgaacgggggagcagcggcaaccagccgttctctgtaggggcggcccttatggccgcccggacggcgggagtctggggcggggaggaaagaggtgggcggggacaagccccgcccctacgcgtgagcattgaacgaggggagcagcggaaagcagccgcgctttgtaggggcggcccttgtggccgcccggctggccggagcctgggacgggaacgaaagaggcgggcgggtgtgggcacccgcccctatgtgtgagcgttgaaacgggggagcagcggcaaccagccgttctctgtaggggcggcccttgtggccgcccggctggccggagcctgggacgggaacgaaagaggcgggcgggtgtgggcacccgcccctacgtgtgaacgttgaaacgggggagcagcggcaaccagccgttctctgtaggggcggcccttgtggccgcccggctggccggagcctggggcgggaacgaaagaggcgggcggggacaagccccacccctacgtgtaagcgttgaacggggggagcagcggacatccgtccctgtatgtccacgcttttcgggcgcggggaaggaaaaggaaaggcggcccaaatgggccgcctttggaaaacaactcagaacttgatgcgctctgcgatataattcttgacctcgctcatggggatacgcacctgctccatggagtcgcgctcccggatggtgacgcagtgatccgcggaggtggtgtcgtcgcccacggtctggaagtccagggtgatgcagaagggggtgccgatctcgtcctggcggcggtagcgcttgccgatggagccggtgtcgtcatagtccaccatgaagtcgcgggccagctcgtcccgcagctgctgggcggggccggagaggacctccttcttgctgagggggagcacggcgcacttgaagggggccagggcggggtggaggcgcaggacggtgcgcacgtcgttgttgcccttcatgtcctggccgacgatctcctcgtcgtaggcgtccaccaggaaggccagggtcacgcggtcggcgcccagggagggctcgatgacataggggatatagtgctcgttcttctcctggtcgaagtaggtgagatccttgccggagtgctcctggtgctgcttgaggtcgtagtcggtgcggtcggccacgccccacagctcgccccagccgaaggggaacatgaactcgaagtcggtggtggccttggagtagaaggccagctcttcgggctcgtggtcgcgcaggcggaggttctcctccttcaggcccagatccaccagccacttgcggcagaactcccgccagtactggaaccactccagatcggtgcccggctggcagaagaactccagctccatctgctcaaactcccggatgcggaagatgaagttgccgggggtgatctcgttgcggaaggacttgcccacctgacacacgccgaagggcagcttcttgcgggtggtgcgctggatggcggggaagttgacgaagatgccctgggcggtctcggggcgcaggtagacctcggtgctgctgtcctcggtgacgccctgatgggtcttgaacatgaggttgaacttgcggatgtcggtgaagtccgccttgccgcagccggggcagatcacgccgttgtcccggatgaaggccaccagctcctcgttggtcatggcctccacattcacgtcgtcgcggccattctcggcgcaccagccctcgatgagcttgtcggcccggtggcgcatcttgcaggccttgcagtcgatgaggggatcgttgaaggtggatacatggccggaggccacccacacctcggggttcatgaggatggcggcgtccaggcccacgttgtaggggttctcctggacgaacttcttccaccaggcccgcttgacgttgtttttcagctccacgcccagagggccgtagtcccaggagttggccaggccgccgtagatctcgctgccggggtagacgaagccccggcccttgcacagggccacgatctgatccatggtcttttcggtgttcttcatatccataagctcctttttgcgttattctgcgcggaaaaaaacgccctgagccgaacggctcagggcgaagcaaactccgtggtgccacctgaattcggggcagaggccccgcgctcaaacccggtaacggcgggggaccggcggggcatttcctccccgcggctggcgggcgccttcccctgcctccgccggagccttgcaccagacggctcctctcttgggacggtgggacggggtacttctcccggtcaatgcctgtttctggccgctattgtatcacgcaaaccgcccgccgtcaaggcgtttcggggcctattccaccagaatcaggccgaaatggttccgttcctcccccaacacccggagcgtgcgcacctccaggccgtgggcgcgggcggtggcaaacacgtcgatgccgcaggcctccatggcggggacggccttcccggggaagcggcacccctcgggcgcgcaggagggacacagcttgcagggcccgctgccgaaggccagggccttgtagtacccgtccagaaagagccgcctggccccctcggcggccatggcggtggcgttccagtggtggacccggaacaggatgccggtggaaaagctgtccagcacggcccgggtgcgggcgtagtccggggcctccggcgggcagcagtggtttttgccgaaattctcacagccgaactggcacttgaaggtggtccagggggcggtgaccaccgtgtgtgggtcgatcaccagggccggctcggccccgttctcccgcagatagtccaggcaggcgtccatgggcagcactcctctctgctcagagtgtatgcccgccgggggaaaagatcaagaagcgggggagacaaaatccacattgtgtgctatgatgtggataaaaaacagaaggaggctgttgtccatggcgcgtccggcgattcgcatcaccctcattgaccggctgggaaagcggggctgccaccggggacaccgggtgggggagagctttgactttgacacggagcgggggaagctctgtcccatggccatgcatgtggcctttccctatgtggatattctccgctatggcggtgccatccccggccagccggcgggcacggcggtgttctgctgccccgatgtggacaccatcaatgtgtttcggatcgaggtgtcggacggggcggccgacccgggttagctgagaaagagctccacgtccccgatggtcaggccggtgtgaagggccagattgatcccgtatccgatgaccttcgccagatcgtgcacctgggtgtcgatgtccttgggggtgacgatcaggccgtcccccgcgccctggagggcggcggggttcagctcccccttgcccgcctcggccagcacgtcgcaggtgagggtggcggcgtccactacggtggggacgccgacggcgatgacggggacgcccagggtctcggcgttgagggcggcccgggcattgcccacgccggagccgggggtgatgccggtgtcggccagttggatggtgcggcagacccgccggaggctgcgggaggccagggcgtccaccgccaccacgcaggcgggcttgatctgctccgcaacggcgcggaccacctcgccgctctccatgccggtggtgcccagcaccccggcggccagggcggccaccggccggaaggagccgaagtgctccggcacccgttccaccaagtggcgggtcaccatggtctggtcggcagccttggggccgatgttgtcgggggtgatggcccggttgcccaggcccaccaccagggcgggcgcgcccggctccaggcccagcagcgcccccagctccgccgccagggcccgcgccgcccggccgaaggcgtcctcctcccggcgggccaggccgtccagctccagggtcacataggtgcccaccggcttgcccagggcccgggcgcccgcctcgtcccggatgcgcacggtggtcaccggatagccctcccgcgttgcctcctccgactccacgcccggcagcgtcccggcctccccggcgctctcctgccagagctgggcggcctccagagccaggtcggttctccgtttcaacatatacgtccctccataccccaagatgtggtgttgatgacaccagatgcccctattttttgcgcagagcgcctccatatgcaaaaaaagtgaaaaaagttcaaaaaaagagttgcatttttaaagaatggctgttaaaataagaatctgcacgggcaaactgtgtaaataacgattacgtcatcggaggaggtgtttggtttgccgaatattaagtctgccaagaagcgtgtcctggtgaacaagaccaaggctgcgcagaacaaggccgctaagtccgcgctgaagaccgacatcaagaagttcgaggccgcggtggtcgaaggcaaccgcagcgaggccgagggcgcttacaaggtggccgttaaggcggtcgacaaggctgtggtcaagggtctgctgcacaagaacaacgccgctcacaagaagagcgccatgaccattaagctgaataagctggcctaaaggtctggtcgaaggggagaccgtctgcatccgcaggcggtctttttcgttttttcgcgggagaaaacgggtatgctggaaaagagacgcgggggaggcggggaaggatgaaaaagctgctggagtggaagccggtccggtttgggctggaggtaggggagctctatttctccaagcgggtatcccgttcggctgcggagctggcctactttctgattctcaccttctttcctgtccttatctgcattaacgccttcatcggactgctccatttggacatcaacgccgtactggaggccgcctcccccttcctgccccgggagacgctggggattttaggggactatattcagtatattaccggaaaccagtcacccgccctgctggccgcgggagggattatgaccctgttctccgcctccgccgccttccgggcgctgatgaatattatggaggatctttacggacgcaagagttatgcaggggtgtggcgcatcgcggccagcgtggccttttcggtgctctttctgcttaccatctacctggccctggtggtgctcctcacaggcgggtggcttttccatctggtggagcgcctgtttcgcctggaaacggtcaccctgccttgggactggcaatggttccgctttctgctgctgttcctgctggtgttcctttttgtcctgctggtgtaccggatggccgcgccccgaggcaggccaaggccgcctatccttacaggtgcctttctggccgccgtagcccttgtggccgccaccgccctgttttcctggtttatcggcctgtcttccaggtactccctggtctacgggtccctggcctcggtgattatcctgctggtgtggctctacctgtgtggaaacatcctgattctgggaaatgtctttaactgcgtgtggtaccgccacaaaaagcggcgggtcacaggggagcggccgggctgaaaaaaggcggcgtaccgatccggtacgccgccttttttcacaggctgcggagccacagctcccgcagacccatcaattgaagatggggctcatactccaccgcccggcggagcaggggtagaatgtcacggccatgaccgccggtaaggactacggtgacggggcccagctcctcctccaggcggagggagatcccctccagggcggcggcggccccgtagagggcgccgctgcgcatgcaggacacagtatcggtacccagcagtccctcgggctgggtaaaagtaatgcaagggagttgggcagcccgggcactgagggcgtccaccgacaggcgcagccccgggagaatcatgccgccccggaatatgccctcccgatccaccaccgacagggtggtggcggtgcccatgtcaaagaccgccagagggggccgccaccgggccagggcggccacgcagtccaccagccggtccatgcccaggttggagacgtcatagtctccggtgggcaggccggggtcgagatcccgccccagcacccggacagggcggcgggtgagggcctccgccgcctggacggcgacctgggtgagggagggaaccaccgaagagagcaccgctccctccacgtcttggggggccgctccctcctctgccagcagggttctcatgcgcgcggcgcaggcggcggcgtccatgttccggtcgctgggcaggcggcggacaaagcgcagctccggccccagaaagccgccaacagcgactgtagtgtttccaatgtcaatggtcagcagcatggctcagacgggctcccgggcggccaggggagcgcggttgagcttgagagcctttcccatggggatgcacactgcggggacaaggatggccgccacaatggcctcgggcacaccgttggccgccacgatgcccagaataaagcccagcactgcctcggctggaatcccctgggccgcggcgtaggcatcccggaacagcagagcaatcagtcccattaccagggcggtgttggtaaaggcgcccaccacggcggacagggccatgctgccggcttggaggacggagccccggcggcgggacagggcctgaagcagcgtatagaccagccagggggtcacgccgacaaggatacggggcacaaaacaaaccaccagggcccaggggctgccccggtccaggcctggtaccggtatcaggggggaaaaggcaaaggaggacaggttgggtaccagggtatttttcaaaagactggccagaccaaacatgccgcccagaaaggctcccttcttgggtccgagaaggagggcgccgatgatgactggcacatggagcacggtggccttaatgatgggcaggtcgatcatgccgatgggggtgaaggtgagcagaaagagaatggcggtaaacatggccaggacagccaggctctgcacctgccggtgctgctgggcgcgggggtgtgggtgttcatattcaattacctccaggctgccgttcccgacgggcgggatacagcgcgtatttggatgcagccacaggcagagatgggcctgccgtctccctccggggagtacagcggcccgccgcccgggacagccgaggccattataacggttatatcctcagattgcaatcccattgtggaaaacctgcggctgttttggtataattggatgactataacggagcataggggcggatgtccgcatccgcccactgacaaaggagagacctgcatgttaaagggaaaaactgtgctgctgggtgtcaccggcggcattgcatgctataagtcggccggcttggcctcggccctggtgaagcagggggcgaacgtccaggtactcatgacccgaaacgccacggagtttatcggcccccacacctttgaatccctgacgggcaaccgggtaagcgtggacacctttgaccgcaactaccagttccaggtggagcacatcgccctggccgaccaggccgacctggtactggtggccccggccacggccaacgttctggctaagcttgcccacggcctggccgacgatatgctcaccaccaccgttctggcctgtgactgtcccaaaatcgccgcgcccgccatgaacacccgcatgtatgagaatccggttacccaggataacctggccctcctgcggcggtacggctgggagattgtggagccggccagcggacgcctggcctgcggggccgtggggaaggggaagatgccggagccggaggagctgctggagacggtgcttcacgccctctcccatgccaaggacatggagggactgaaggtgctggtcaccgccggccccacccaggaggcactggatccggtgcgctgcctgaccaaccactccaccgggcggatgggctacgccgtggcccgggccgccgccgcccgcggggcggaggtgacgctggtgtccggccccacggcgctgaagaagcccgcctatgtggagacggtggacgtggtgtccgcccaggacatgttcgaggcggtcaccgcccgcgccccggagcaggacatcatcatcaaggccgccgcggtggccgactaccgcccggcccaggtggcccaggacaaggtgaagaagggggagggggagctgtccattcccctggagcgcacccgggatatcctggcctggctgggggagcaccgccggccggggcagttcctgtgcgggttttccatggagacccgggacatggtggaaaactcccgcaggaagctggagaagaagcacctggatctgattgccgccaacaacctcaaggagccgggcgcgggcttcgcagtgccaaccaatctgctcacgctgatctccccccgggaggagctggagctgcccctcctcaccaaggaggaggccgcccaccgtctgctggatgaaatcctgaagctccgctgagccgaaaaaaccggcgcacccgtcagggtgcgccggtctttttcagctcagataggacagggggttgacggaggtgccgttgatcttcacctcgaaatggcagtggttgccggtggagcggcccgtggagcccaccttggcgatgggctgaccctggtagaccttgtcgccggcggaaaccaggacgctggagcagtggccgtagtaggtctgcttcccgttgccgtgatccacgatgaccagattgccgtagctccacatgctgccggtggcccggccggcgaagaccacggtgccgccatcggcggccgcgatgttggtgccgtaggaggtggcaatgtcaatgccgccgtggtagctgtaggagccaaagatggagcggtagccgaagtaggaggtaatgcgcccgtatacgggccagataaagtagccgttgggcagccaggaggggcgcaccttggtgcccacagcgatgaccttgttggtggcctcccgggtgacctgggtagagagcaccgtgcgctcctgctccacgccgttgaggtaagcgatgtccgcgttgacgatctgctcgccggggacgcctgcatccagcaccttggactcgccctggtacatggagtcgtcctgcacctccaccaccgggcactcaatggactcggtataggtcacgttatccaccgtcttgacggagaggaagggaatctcctccttcacgttgaggagctggccgatgtagatacggttaatgtccacatccgggttgagggcctccagttccgacatgctcatgtcgttgtcaaaggcgatctgcatgaaggtgtcgcccttctgcacctcataggtggtctggccgttggtgttggcggtgagggtggccagcatggccgccgggtcctgattgacatcggagggggtgtactcgtgggtaatgtagaccccggaggtaaactcggcggacactgtgttttcatctacataggcagccttcacctgctccagcaccccattcagggtctcccgatcctgggccgcgccgatgaactggccgttgacggtgagcacatagctcttcattacctcgccaatctggtcaaagaggtaggtctcaaagtccgccacgggggtgatggactcccgctccgtcagggcaggggcgtaggtcaccgcgccgtccatggtatagtcgtagcccagaatatcggtggcacggctctccacccggtccaccacatcctcaaacacagaggggctggtgacggtgcccagggccacgccgtccacctccaccacatagctgggagtgtagacagtgcccaccacagccgccacgccgatgaccacggcggcggccaggaaatgcaggggattgatcagccggcggccgcccgcagtggcggcgtccagccggcggcggagcggctccacgcgctgcgccagggccgcggtacccgcctcccatctgtcccggagttgggccaggggcggccggatggccgaagactcctcccggggcgtatgcagaatttcgtccatgagggaaaccctcctaattatttgttcttgcgtaaaagaaggcccgcgagggccgaaaggtaacagtcagaaacgaaaagttacaaatggttacaaggcgtatcatacacgctttttgccaaaaagtcaagactttgactggaaaaggcgggaatccgcggcaattgaaggtcaaagcacaaccgacacgacatatagtgggcggctttcaaaaagatgtcctactactaccagaaggagaaatggtcagggcagagcagcaaaaagatttgtccactttgaccgggacgaaaagcccccacggcatcctttttggtgccgcgggggaccggaggggacgggggatctccccccatagccggaaaaagtccggagtccctgaaggaaactccggactttggagggccagttaggccagcgcggcggtgatgatggccatggagcaaccccccacaggcaggtgcctgtggggcccccggcttttttactgcgcgggacaagtaatgccccggcatcaaggttttgcgctcttgacgcaaaacgcttgacggcgcgagcgccgtgcccccggagtgggcggaggtctcctctatggccggaaaaagtccggagttcctgaaggaaactccggactttggagggctgttaggccagcgcggcggtgatgatggccatggagtagacctcctgggcgttgcagccgcgggagaggtcgttgatgggggcgttcaggcccagcagaatggggccataggcgtcgaagccgcccaggcgctgggcaatcttgtagccgatgttgcccgcgttaatgttggggaaaataaaggtgttggcatagccggccacgggagagccggggaacttgagctggcccacggtgggggagacggcggcgtcgaactgcatctcaccgtcgatggccagctcgggcgcggcagccttggccttggcgcaggcgttgcgcatcttgtccacagtgtcgcccttgccggagcccttggtggagtagctcaggtaggccaccttggggtcaatgccgaaggttttggcgcacttggcgcactccaggccgatctccaccagctcgtcctccgtagggtcgatgttgatggcgcagtcgcccatggccagcacagtgttgtcgcccacgccctcgcggaccataatgaagcaggaggagacgattttattctcgggcttggtcttgatgagctgcagggcggggcggacggtgtcggcggtggagtaggtggcgccgcccagcagacagtcggccacgcccatcttcaccagcatggtgccgaaatagttgcccttcatcagggcggcgcggcactcgtcggcggtcatcttgccgcggcgcagcgccaccatctcctccaccatcttgtccatgtcgggataggtggcggggtcgatgatctcagcaccccggatgttgaagccgacctcctcggccgcggcctttacctccgcctcattgccgatgaggatgggggccagccaggtgccggccagcaggcggacgctggcctccaggatgcgggcgtcggtgccctcggtaaagacaatgcgcttgggggactttttcagggtgtcgatgagctgctgaaacatgtgaatggccattggtatcttcctccatcataaaaaacgtacgtcaaatgccaaaatgctcggcgtcggagctattatacaccatttcgactgcggttctcaatgcctaaaagccataagattgtgaaaaaatacactttactttttgtattctcacatttatactatacctactgttttgaagccagttgaagttgaggtgtgttatgagttccgatttttcccgctgcctttccctgctccggcaggagaaggggatctcccagcgcgcggccgcaaaggatctggggatcagccaggcgctgctctcccactatgagaacggcgtgcgtgagcccggtctggcctttgtcacgaaggcctgcaactattataatgtgtcggcggacttcctgctgggccgtaccctctcccgggacggcaccaccatcgccgccgaagagctgtacgattactccaccgagaaggacaacgtgctccacggctccattatggccacgctgaacaaaaagctgctggtcaactccatcggcgtgctcttcgacctgctgggcaagaccggccgcaaggaggccattaacgccgcggcggactacctgggtaccgctgtttacaagatgtttcgccacctgtaccgggcggatggcagcaagaacgaggacttcttctccgtgcccgcccggcagtttatggcgggcgtggccaccgccgacatgatctgtaccgaggcccagtatgtggacgccctggccgcccacgtcaaggagaaggggagcttcccgcccatgcacaacgacgcgctgatggagaactaccccggactgtaccagtccctgctccagattatccacaacaccggggagcgggtcaaccgccggatggagattcagaaccagaagtagggcgcggcatcccggacgcgccgcctgtttaccgggtacgcccggggggcgccaccggtaccatgcccttgaacggccggggcggccgcagtagggatatgcagagtatcgctccaatgtcaatcgacgctttcacatcttcggaggtgtatttttttgacggaccagagcaaaatccgtaatttttcgatgattgcccacattgaccacggcaaatcaaatcccgcggagtctgtggactccgcgggtaccccgtgttattttgcatcctcggcggaagtaaattccgccttcggcaaggttttgtccgggggacaaaacgcttggacgcggcaggccgccgcgccccgctgcgcggggttccgggtggatttgccgaagggaggactgtgccatgactgaccaatccaaaatccgcaacttttccattatcgcccacatcgaccacggcaaatccaccctgtctgaccggctgattgagaagtgcaacgccgtttcccagcgggagatggagagccagctgctggacaacatggatctggagcgggagcggggcattaccatcaaggcccgggcggtgaagctcaactatcaggctgccgacggggagacctatgagctgaacctgatcgatacgccgggccacgtggacttcaactatgaggtgagccgctccctggccgcctgcgagggcgcggtgctcatagtggacgccgcccagggcatcgaggcccagaccctggccaacaccttcctggccctggagcacgacctggagattctgcccgtggtcaacaagatcgacctgcccgccgccgaccccaagcgggtgaaggacgagattgagaacatcatcggcctgcccgcccaggacgcccccgagatctccgccaaggtggggctgaacatcgacgcggtgctggaggacatcgtgaagaacgtccccgcccccaagggcgacccggaggccccgctccgcgccctgatctttgacagccagtacgacgcctaccggggcgtgatcgtctatttccgtgtgatggagggtaccatcaagaccgggatgaaggtgaagatgatggccccgggcgcgtcctatgaggtgctggagtgcggccacctgctccccctggggatggagccctgcggcgagctgatcgccggcgaggtgggctacttcactgcctccatcaaaaacgtgaaggatacccaggtgggtgacaccgtcaccggtgtggagcgccccgccgccgaggccctgcccggctaccgccccgcccgcgccatggtgtactgcggcatttacaccgaggacggctccaagtatccagatctgcgggacgccctggagaagctccagctcaacgacgcctccctgtccttcgagcccgagtcctccgccgccctgggcttcggcttccgctgcggctttctgggcatgctccacatggagatcatccaggagcggctggagcgggagttcgatctggatctcatcaccaccctgccctcggtgatctaccgtatcaccaagaccgatggcaccgtggtcatggtggacaatccccacaattaccccgatccggcggtgatcgagctggccgaggagccctacgccaaggtgtccatcgtctcgccgcccgattatgtgggcaacatcatgcccatgtgccaggagcgccggggcgagttcaaggacatgcagtatctggacaccaacctggtggagctgcactactccatgcccctgggcgagatcatctacgacttcttcgacaccctcaaggcccgcaccaagggctacgcctctctggactacgagctggacaagtacgagccctccgagctggtgaaggtggatatgctgctgaacggcgatcaggtggacgccctgtccttcatcgcccaccgggagaaggcctacccccgcgcccggcggctgtgtgaaaagctgcgggacaacatcccccgccagctcttcgaggtgcccgtccaggccgccatcggcggcaaggtcatcgcccgcgagaccgtccgcgccatgcgcaaggacgtgctggccaagtgctacggcggcgacatcacccggaaaaagaagctgctggagaagcagaaagagggcaaaaagaagatgcggagcttgggaacggtacagattccgaccgaggcattcatggcggtgcttaaattggacgaagagtaagcatccgcaaagttccctcctcgcgccgtagccgctgcggcctacgctacaaacgtgccaccggcacgtttgcttaacgctgcggtggcggttcttaagctggatgaggaatgacggcatcttctttttgacctctggggccccacagggtggggcggcgcttgcgccgtacaagggtttcgccgggggcgtaggggcggggcttgtccccgcccgcaggcgggctggtgtgggcatcggcccctacgggagaagcgcgggcggccacaagggccgcccctacaaagaggatactatgagatacaaaaccaggagcacaccacagcggtgtgctcctggtttttgtttgatccggttttccacatgcggaaaggatcctgtggaaaacttgcgaaggcggttactcggcggcctcgtcctcctccttcttggtgcagacgatgttcagctcgtccagctgggcttgggtgacgaaggaaggggcgcccatcatgagatcctgggcgttcttgttcatggggaaggggatgatctcccggatggagtcctcgccggccagcagcatgaccatgcggtccacgccgggggcgatgcccgcgtgggggggcgcgccgtaggtgaaggcgttgtacatggcggggaacttggccttcacgtcgtcctcgcccaggcggacgagctggaaggcctcgatcatgatctccggatcgtggttccgcacggcgccggaggagagctccacgccgttgcacaccagatcgtactggaaggcggtgatggacagggggtccacctcgccggcggcggcctttttcaggatctccagtccgccgttgggcatggagaaggggttgtggcagaactccaaaagcccggactcctcgccgatctcgtacatggggaagtccacgatccagcagaactcatagcactccttgtccatgtggttggggcagaaggcgcccagcttggagcggagcacgccggcggccttctgggcggccaggagcttgccggctgtgaggcccacgaagcagcccttttccagccccagagcggccaccaccgcgtccttcatgggctggacaaacttggcgatgccgccaacaatctcgccgttctcgtcgtagcggaaccagtaggccttttcgccggactggacctccacgtcggcgcacagcttgtcgatctgcttgcgggtgccctcgaagccggtgaccaccaccgccttgacggtgttcccctcaaaggggccgaagccgcaggcgcccagggcctcagtggcgtcggtgacggtcagatcaatgcgcagatccggcttgtcggagccgtacttgtccatcgcatcccggtaggagatgcggcggaagggggcggtggaggccacgttgtaggtgccgtactgggcaaaaatggggggcagcacgtcctccaacacggcgaacacgtcctcctgatcggcaaaggccatctccatgtccagctggtagaactcgccgggggagcggtcgccccgggcgtcctcgtcccggaagcagggggcgatctggaagtacttgtcgaagccggaggccatcagcagctgcttgaactgctggggggcctggggcagggcgtagaacttgccggggtgcttgcggctgggcaccagatagtcccgggcgccctccggggaggaggcggtgaggatgggggtggtgatctccaggaagccgtggtcaagcatggccttccgcagggcggccaccacctggcagcggaggatgatgttgttcttcacctccgggttgcggagatccagatagcggtacttcaggcgggcggactcgtcggcctcccggctgcggttgatctggaagggcagctcgttgtggcggcagcggcccagcacctccaccgcctccggcaccacctcgatgtcgccggtgggcagcttggggttcttggagtcccgctcccgcaccacaccggtgatctggacggtggactccttgttcagccccttgaaggccttccacatggcctcgttctccacgaccacctgggtcaccccgtagaagtcccgcaggacggcgaaggcaaagttctggcccacctcgcggacgttctccagaaagcccgccagggtgacggtctggcccacgtgctccatacggagatccccgcaggtgtgggtgcggtaatgggtatgggttgtctgcatcaaaaatcaactccaaattgtaatataagaaggataaaatacaaataggatcgaaaagagagccatataggcagatcggaacgcccaaagggacgcgggggcgggccgatgtgggcatcggctcctacgtgggacaggggcggccacaagggccgcccctacgggagaggggcgtatagaggggtgtaggggcggggcttgtccccgcccggaggcaggccaatgtggacatcggcctttacgggagacacgggcggccacgggggccgcccctacgggagaggggcgtatagaggggtgtaggggcggggcttgtctccgcccggagcgggccgatgggcatcggcccctacgagggagacgggcggccacgagggccgcccctacgggagaggggtgtatagggagatcgtaggagcggggcttgtccccgcccggaggcgggccgatatgggcatcggcgcctgcgtgggacacgggcggccacgagggccgcccctacgggagagggggcgtataaagggatcgtaggggcggggcttgtccccgcccggagcgggccgatgtgggcatcggcctttacgggagacacgggcggccacaagggccgcccctacgggagagggggtgtatagggggatcgtaggggtgggtgcccacacccgcccggagcttatcccttctgatcctgatagcggctgtaatacacctgcatgtcgaagtcctggtagagctgggtgccgtccttggcggtgacgccgaagtgggccagggcggtgtcctccacatagtccaggaaggtcacaccgtccacggtgttaaaccagttgaactccatgccctgggcggcgcagtcggcctccaggccgtcgatgagggtctggatatagggcagatactgcccggcggtgacgccgttggtgaagagcacgtcggcgggcttgaggtaggcggcggtgaacatggcgtagtcggcgggggtgaagcgctcccgcagctccggccgggcgacccgggccaccatggcggcggtctccgcccgggtgagggtcttgccgggggcaaaggtgccccagtcgtccacgccggtgaggatgccggcgttgtagaaggacagcacggcggcgtcggcggtgtcgggcagggcggtgatctggttgatgggggtcagcatatcctcgggcaccacggcggcaagcatggcgatgaactcctggcgggtggcctgcttgacgggatcgggcacctccacccccagcttctccagatagtccacataggaggtgtaccagggcaggatggaatccaccaggtaaatggagtcgccggtgatggcctcgttcatgcgggcggcgatggcggccacctcgcccacggtgagcacctggtcgggggcaaagccggcgccggtgccggtcatgaggcccacctcatagcaggtctggacagtggcggcgtaccaggccgaaccggccacatcggcaaagccgggataggtgttgacggcggggaaggcctcctccggcgcgatggcggcggaggagcctgccagcagggcggtggacagggccagggcgatgagctgctttttcatggaacatttcctcctgtacgtcgggttttccccatttagacggggacatggggagaaggttccatcaggcctccggctcctggatgggagtaccgcccgcccgggccgccagcccggcctgtaccaaggccacggcctccccggccgtcacggtctgctgctgcccggtggtcagatcctttaccgtcaccttgttctgctgaatctcgtcctcccccaggaaggcggcgtaggggatggacagcttgtccgcataggacagcttctgcttgaacttcttcttctcacagtggagctgggcgcgcacgcccgcgtcccgcagggcggtggcgaaggagatggcgggggagagctcctcggtcatggggaggatcagcacgtccgccggggcggtgaccagggcgtcgttcagatagccctgggcctccagtacggagaacaggcgggtcagaccgatggaaataccgactccggggagttgtttatcggtataatattccgccaagttatcataacggcccccggagcagatggaacccacctccgggtgatccagcatgacggtctcatacacggtgccggtgtagtagtccaggccgcgggcaatggtgagatccaccatgaagtgctcctccggcacgccgaaggcggacatatacctgatcacggtctccagctcggccacgcctagatcgaaaagctcgttcttccccttgaagggctccagcgcggccatgggatcgccggcggccaggagggcgagcagggcgtcggccgccccgccgggtacggcgaagtcgtccgtcaggatggcgcgcaccttctccgggccgatcttctccagcttgtcgatggtgcgcatcacgtccccggcctgcttctccaggcccaggatggcgaacaggccgttgagcaccttccggttgttgacccggatcttgaagcggcgcaggcccagggcggtgaaggtcttgtagatgatggaggggatctccgcctcgttggtgatgttcaggctgccgtcgccgatgacgtcgatgtccgcctggtagaactcccggtagcggcccttctgggcccgctctccccggtagaccttggagatctggaaccggcggaaggggaaggtcagctcattctggtgcagggctacatacttggccagaggcacggtgagatcaaagcggagggcaaggtcggagtcgcccttggtgaagcggtagatctgcttctccgtctcgccgccgcccttggccagcagcacctcggccgcctcgatggccggggtatccaggggggtgaagccgtacagggaataggacttgcgcagaatctccaccatccggtcgaactgtacctgccgcgcgggcagcagctccataaaaccggacagggtgcggggtttgatctgggccatagtgatgctcctttttaacagtaattgaggctgctgcccgcctcgccgcgaaagcggcgtcaagcgttttgcgcagcaaaaccttggaacaggccgaattcacttcggcctgtttggatgaaaaagaggggctcccggcgggtcagcagctccataaagccggacagggtgcgtctcgtctccacactggccgggccgatgtgggcagaaggtgaattgccccagaggggcaagagaggccgccctggggcgtcggcccctaccgggcggcggagggactcagaggccggggtgggccgtaaaaaggcgctctcgtcccctgccacgggacgaaagcgcctgctttcgtggtgccacccatgttcagagcggaattccgctccctctgtccttctgttgcgggaaggggaccacacccgtctccgggcccgctggtaaggccgtctcccggcctcctgccgcggacgctttcagccggaggcgtccttctctgctgcggcggtgtgggcggtacttgccccgtcagggcggtttttgctccacaatactaccccaaagcggggaaaaagtcaaccgggaaccgcccagttacgcggtaaagggcttggtcttggggttgatgatatcgcgccagtccaggtccccccgctccaggccgtggatgagaatctccgccgtggccacattggtggcgaaggggatgttgtactggtcgcagagggtggtgatatacttcagatccgcgtccagatcgttggactgggggtctgagaagaaaagcaccatgtcgatctcgttgtaggcgatgcgggcgccgatctgctggctgccgccgtgctcgtgggagaggaagagctggacaggcaggccggtggcctcggccaccaggcggccagtcgtgttggtggcgcagatggtatgcttggagagaatgccgcagtaggcaatgcagaactgcaccatcagctcttttttccggtcatggctcatcagggcaatattcatcgtactaacctctcttccacagcgtgttgcgcttatcgcattttcataaggggggccttctggccaagcaggcgcttggcaatgttgagataggcgacggcggcgccccggctggcccggagaatgaggggctggccctggttggcgcacagcatcacctggggatcctccggcacaatgcccagcaggggcaggccggcggcgtccatggcgtcgtcaatggtggtgtgaaggcggcggagcagccggggctgtacccggttgaccaccagatggatgcgggggatgcggttccggagcaccgaaaccgtgcgctgggcgtcccgcagggcggaggcgtcggtcgtggaaaccaccacggcccggtccgccgcacagcaggccaaacggaacccctcgcccagccctgctggcgaatccatcaggatgtagtcgtacccctccctggcccggtgaatcagctccttcatggccgcctcgctgagcggcgcttcgggcagggtgacgggggcggtgaggaggaacaggccttggatgacggggtgggggacggcggcccgctccagtgtgcagcggccgcagagcacgtcagtgaagtccatcagcgcccggtcgctcagacccaaggtcaggtccaggttgcgcaggccgatatccatgtcgatgcagagcacccggtggcccagcgcggccagacaggaggctacaccgccggtaatggaggtctttcccgtgccgccctttcccgacgtgatcacaattgcagtggacataggttcactcccgttgtttgacgtaaataccatatcatacttccacagtggaatcaatgggtttttgtgcagaatagtgagaaaattcctgctacagcggggctttctgtatctttgcccaccggcgggggtagccattgggggtgggggtgcacttctccaccagcaccacccggtggcgcacattggcgccgggaatgacatagtccacactgggcagcagccgcccgccgaggatggagatgcaccgggcggcgtggttgatctcctcgccgctgtccacgcccttcatggccagaaatctgccgcccaccttcagatagggcagacacagctcgcacaggagctccagggaggccacggcccgggacacggcgtagtcgaagccgtcccggtagccgtccaccagggcctgctcctccgcccgggcgtggaggcactccaccccctccaggcccagggtattgcacaccgaggcaagccaattcacccgcttgcccaggctgtccagcagggtgagctgaaggctgggctccaggatgcgcaggggcaggccggggaagcccgcgccggtgcccacgtcgatgagccgcttgccccggaggtcctcccccagggtgagcagggcggcggagtccagaaagtgcaggtcggccacctggtcgggctcggtgatggcggtgaggttcatgacctggttctgctccagcagcagacggccgtactcagccagccgggccgctgcgccgtcgggaggcgtgaggcccagggcggtcaggccggaggcaatacgcgcttgcatgctcacacccccagtccggccagcagggcgggcacgccctgcaccaggccgattacaaggatcactccgcaggccgccgccagcagggccatgcaggcctttttggagtaggtgcactccggccggcggaactgccagacggtaatcaccgccagaccggcggcaccggggcagaccagcaggggggccagcccccggagataggttccgccgtggaaaaacgggtagaggttgagggcgacgaagatcagcatgtaggccacccccacccaggcaatgatccgcttgacaggggaggcaggcgtataggaggacggctccttctggtttttattatctggtagttcagccatttttttgctccttcaaaagatcccgaatctccgtgaggagcgcctcctccgccgatggcttggggggcgggggaggggcggcctcctcctttttgtggagacggttcagcagcttgacgatgcagaacaccacaaacgccataatcaggaagctgagcacggcgttgagaaagctgcccagcatgaggtcgccgccgccgggcagggggatagacaggccagccagggcctcattgtccccggcgaagatgccgagcaccgggttgaggatgtcgtttaccagggagtcggtgattcccttgaacgcgccgccgatgatgacgccgacggccagatccatcacattgccccgggcaatgaatttgcggaattcggccaaaaagccggtggttttctctttagcagacataaaaactccttatttaaacgataagcgacaaaagaacggggagaatagccccagttagggattcttgacactccagccccagtccatatccatggggggcgtgtgcggggtgggggattccaggccgtacttttctgagatagcgtcaatctgctcctgggtaagcgtctcctccggctgggcggattccgcaggctggggcccggcggtacagccgcccagcagcagggcggcggcgagcaggagagcggcggccggtaagcggtgcttcatgacaaaggcgctcctttcaatacgtgggagagcggcttactgcttgggcgtcagcacttccttgccgcccatatagggccgcagggcggcggggatcttcacgctgccgtcggcctggaggttgttctccaggaaggcgatgagcatgcggggaggggccaccacggtgttgttgagggtgtggggcaggtaggtgccgttctcccccttgacccgcatcttgaggcggcgggcctgggcgtcgcccaggttggagcaggagcacacctcgaagtacttctgctggcgggggctccacgcctcgatgtcgcaggacttgaccttgagatcggccagatcgccggagcagcactccaactggcgcacggggatgtccagagagcggaacagctccaccgaccagcgccacatcttctcgtaccagtccatggactcctcgggcctgcacaccaccaccatctcctgcttctcgaactggtggatgcggtagacgccccgctcctcgatgccgtgggcgcccttctccttgcggaagcagggggagtaggaggtgagggtctggggcagcttgtcttcggggatgatctggtcgatgaacttgccgatcatggagtgctctgaggtgccgatgaggtagagatcctctccctcaatcttatacatcatggcgtccatctcggtctggctcatgacgccctccaccacgttgccgtggatcatgaagggggggatgcagaaggtgaagcccttgtcgatcatgaagtcgcgggcgtaggccagcaccgcctcgtggaggcgggcgatgtcgcccatcaggtagtagaagcccgcgccggatacccggccggcggcgtccatgtcgatgccgtcgaaggactccatgatttgggtgtggtaggggatttcaaaggcgggggttgctgcctcgccgaagcgttgcacctccacgttgcaggagtcgtcggggccgatgggcacggagggatcgatgatgttggggatctggagcaggatgcggcggatctccgcggccagctcggtctcccggccctccaggaaggccagccggtcggcgtcggccttgacctcggccttcagcgcctcggcctccgccagcttggaggggtctttcttggactgccccatcagtacgcccacctgcttgctcttggcgttgcgggcggtgcgcagttcctgggcctcctggatggtacggcggttctctgcgtccagctccagcacctgatccaccagggggagcttctgttcctgaaatttcttcttgatgttctccttcacggcgtcgggattttcccggataaatttaatgtccagcatggttgattctccttcaataaagtggtgtgagataaacccgtaggggcgacccttgtagtcgcccgcgggcgaccataaagccgcccctataggggagagaaaagtgcgaagcgggtcgcgtggggaagcggagggacaagggagtgcaatggatatccggcgccgtgcgccggatggaatggagcggactttgtgcagatggggccccacgggagcccagcggagcgggtcgcgtggggaagcggagggacaagggagtggaatggatatccggcgcacagcgccggatgaaatggagcggactttgtgcagatggggcccccacgggagcccagcggagcgggtcgcgtggggaagcggagggacaagggagtggaatggatatccggcgcacagcgccggatgaaatggagcggactttgtcccgacgccgtttcacgtgaaacaatcagcccagccactccatgagggactggtaggcctccagggggttgtagtcctgtcgctgctggccggtgagcccatcggccaccgtacccagtaccccctccatgccgcccgctccagccagagcggcctcggcggcggccgccgcatcccgggcatcggagtagcgcccgtcgttgtatagggcgcgaatttggttcaaatagcagagcgcctccagctgcaccagggcggcctcgccgtcggaggcgctttccgcgtcctccagcgcttcctggagctgggccacctgctggctcagggcctcgttttccaccttgagggtctcgttttcctggagaatgttctccagggactgggtagccgagtcggaggtctgctccagcttgtccatggcctcctggttggcccgctgctgcatgaagtaggacatcagcagcaggagaaaagccgctgcaaagaggatgaccaggtagagcagcaccgagctgcgcttgtggggccgctcatgctccgcctcgtgctggaggcggctgcgctcctgcttgtcggaatcggtgctcaaagggaaccccctcctttcccggcggagggaagctgctccagcagctccagcagagtgttcaaatcctctggattgtagtattccagctcgatttttccctttttccggccgttgatgatgtgaaccttgcggccgaagcgggtggccagggtcttttccgcctcccgcagatagatggacaggtcagggccggcggcggacttgggctccgcagcttctctgggttccgcggccagccgcttggccagggcttcggtctgccggacggagagctcctccgcgatgaccttctgcgccagctttttctgcagctccccgctgggcacggccaggatggccctggcgtggccggcggagagcttgccctcctccagcagcaggtgtaccgggtcgggaagggccagcagccgcagggcgttggccacggcggggcgggacttgcccacccgctgggccacctcctcctgggtgagaccgtattcgctcatgagcaccttgtagccgttggcctcttcaatcgggttcagatcctcccgctggaggttttcgatcaggccgagctccatcaccttgcggtcgtcggcctcgatgatgacggcggggatttcgttcaggcccgccagcttggcggcccgccagcggcgctccccggcgatgatctggtagtagcccgacgagagccggcggacggtgaggggttgaatgatcccgtggatgcggatggagtcggccaaatcctgaaggctttcctcgtcaaaccgctttcgaggctgcttgagccccggttccacctgggagatggggagggagagggagcccccctcctgggactggagggcggcgtcccccagcagtgcgcccaggcccctgcccaggccgcgttccaatgccataggtcaatccttcctttccacacgggtgacggcgtattgattgtgctccagcagctcctgggccagggcatcgtaggcctccgcgccccgggagagggcgtcataggcggacaccggcttgccaaagctgggagcctcggacaggcggacgttacgggggatcaccgtggcgtacacctggccggggaagtggcgtttgacctcctccgccacctgcatggagagattggtacggccgtcgtacatggtgagtaccaccccctccagggcaattttggggttgagggatcgcttgacaatgcgaatggtggagagaaggtcgctgagcccctccagggcgtagtactcacattgcaccggtaccagcacggtatccgctgcgcacagggcgttcagggtcagcagttccagagaggggggacagtcaatgaagatgtagtcatagtgttccgccacctgctccaaggcgtttttcagccggtactcccgctgctccagggcgatcatctcaatggtggcccccgccagcgccttgttggaggggagcacatcgccgtaggaggtggaggagatggccttggcggtctccgtcccgttgagaagcacgtcatagatgttgggcgaggtggtcttgtctacgccgaagccggaagtggtgttggcctgggggtcaaaatcgcacaccagcacccggcagccctggtttttcagagccgccgccaggttgacacaggtggtagtctttcccacgccgcccttttgattcacaattgcaatggtctttgccatagcacacctgcctttttgggtcgttgcaaagggtcaggttctattatatagcggcggtagacgtaattcaactgaaattcgcgctgtttcacgtgaaacaggaaaaaaagaggatggagctgtttcacgtgaaacagccccatcctttcaggaaaaccgccatggcctccgcgtacggcgcacctctacttgggaatagtgatggtcagcaagatggagtcctccgtctcctggcgcttgcagttggcctgtacgcccgcgctcttcatcatggacagtccccgggtcacggtgttgagaaacagccgcacatccttaattacaaaggttggtttttttcgggcgggcttgtctgccggatgaagcagggtttccacatgctcctccgtccgggccacagtaagcccctgctctgccacatgccgggcggctgtgcgctggagttccggctcctccaggcggagcagcgcccgggcgtggcgctcggtgcagccgtgctcccgcagcagggtgaggacatcgggcgggaggcggagcaggcgcagcttgttggccaccgccgactgggacttgccgatgcggcgggccgcctcctcctgagacagatggtaggtctcgatcagcttggccagagcggtggcctcctccacaaagttgagatcccgccgctgaaggttctccaccagggccagcaaagaagagccctggctgtccacgctgaccagaatgcagggcacctcggtgagaccggccatgcgggaggcccgcaggcggcgctccccggaaatcagctcgtagccgccgttcttggaccggcggacggacaggggctggagtacgccaagctcctgaatgctggcggccagctcctccaggccctcccgggaaaagcaggtgcggggctggtccggattgggggaaatggcggcaatggggagaaacagcactttggtgctctcaaacagtccttttcgacgcagtaaggacatcggaaagcctcctttgcggtagaatattgactaaccatatattaccatattgtggtgcaaaaaaagccggatgccgtcgattgggaaatattttccaaaatgacagaaagcttcgtgcgcacagggcgtaccgcgaaatgacgcaaaggctcaggcgcatgaagtggttgcgcatgtgggccgtaccgacccacgcgctgtcatcccatggccgtgccgctgttaagcggcacagggctaattttgctctgctctcctgcacagcaaaaaagcccgcccggcatttaggtccgggcgggcggagaatcagggctgtaagaagccctttccaaagatttcactggagttggctacaatgagaaaagcatggggatcaatctttttcaggtagcggcgcagaagcacggcctggcccctggtgaggacagtgagcaccacgtggtgctctgcgtgggtataggcgccctgggcctgccatacggtggcgccccggcccagggtatgggtaatatagtcgcacacatgctccgggtcgtaggagatgacgaaaaaggccttgcgccgattgaaggactcgatggcgctgtccaccagcaccgacttgagggccaggcccagcagggagcacagtcccgccgtgatgtcaaagacaaagagggcggccgccgcgataaccacgtcagagaggagcagggcacgccctacgtccaggccggtgtattttttgagaatcatggcggcgatatcggtgccgccggaggaggcgtctatgttgaaaaggatggcggagcccagggcggggaggatcaccgcgaagaacagctccagcatgagttggtcggtgagagggcggtccatgggaaacgcccactcaaagagctgaatgagcccggcggagagaatggaacagtagaccgtccgggcgccgaagcccctgttgagcattacaaagcccagcaccaaaaagagcacattgatgatggtgttgaaggtagagggggagagctggggcagcagctttcccagcagcaccgccaggccggacacgccgcccatggaaaaatggttgggaaatttgaaaaagtagacccccaccgacaccagcagggtgcccaggttcatcagcaggaattcgcgcagcagttccttgcggttggtcatccgtttcacttcctaagtagatggtaagcgggtcagcgctgggtcagcagggcgctccacacgtcgtaggtaccgtccgccggaatgttgccgatgcgccacagggagactcctgtgatgccgaacatccgggccagcgccaccttgtccagcacgctttgctcgttctcgtaccagaccttgtaacggctgccgtcctcggtagtgtagagggcgcagggattgcggaattcctccgagtagaccacctgggtgtcgggctgggccaggcgcagagccagggtggagggggcggggtggtagatagtggtctccagcaggcggtcctctccgtccacgtggaagcccgccgagccaaaggagatctgcagggccagcttgctccggtcggccacgccggtggccgggtcggtaagatcacgcagagcctcgtacacgctggcgaagggggtgacgggggagtcggtgttggtagtgcctgcataggagtcggggacggaggtccactggtagtcgtgggccatgaggatcaccttgtcggcggcctcgccaatgccccggtagtcaaagccggtgtaccaggtgtcgggctggacgcagacatagagggttttcccctggggcagggcggcgtccagctcttttagaaaggttacataattctgttttatggtatcccccttcaggccctcaaagtcgatggtcaggcccgcgtagtccgcgctggcggcagtcaacgcggccacggcctgggcccgggcctcgggcgtgccggtcaccgccgccaccgtggaggtggtggtgccgtcggggagggggatggaatcgcccgctgaggcatatacatttaagttgtaggggaggctgcgggtatcccagtaatcggtggcgggggtggggtcgtcggggcgcacccagtcgttgccgttggtgcgggaggagttgaggacgggcccggcggcggggtcgtactccatccgggcccagcctacgctcaccgcgtccatggaggcggtgagatcaatctgggaataggaggagaaggcgtaaaagccgtggagccagtccagcttggaggtgtaccgctcgtacacccgcaccagcatggcggcggcctcctcccgggtggcggagtcgcggggcaggaacttgagctggccgcccgccccggccacgccggtgatcatgccgatgtcgtaggcgatggcgatgtacccccggttgtccgtgatgtcgtcaaagggcagctccagcccggacagggactgggccagcgtgccgtagcccagggcccgcaccagcatgaccgccatctcctcccggctgatatagtcctccggacggaaggcgccgccggcgtccatcacgccgtgggccagggcggtctccacataggagtaggcccagtgagaggcggggcagtcggaaaacgagggcgcgcccggggaggcggcatcccagccgaacatgcggcagagcacggccacaaactcgccccgggtcagctccttccccacgccaaaggtgccgtcggggtagccgttcatcaggccatagccctccgccttttcgatgacctctgcggcccaggtgccctccgcgtcggaaaatgcggcgctggccgcgggggagaggggtgcggcgctcaaaagcaaaacggcggccagggctgccgcacagaaacggtgtttcataacaataaacctccttgctcaaaagcgatcaacagcattgtaccaaacccggcgcaaaagcacaatgaaaaaaccggaaagcggggagaacctccgtacaaaatttctaaaaacaggtgacgaaagcaatcttttttgatagaatataggcagttgcagttgtctgtcaaattcgatacaatagaaataactttttcttgtggagtaaggagagggacataatgaaactgctggaggagcgcattcggacccacgggaaaatccgtgaaggcggcgtgctgaaggtggacagctttctgaatcatcagatggacgtgaagctgttccaggaaatgggcaaggagttcctgcgcttgtttgggaactgcggggttaccaagattttgaccatcgaggcatcggggatcgggatcgcatgtgtaaccgcgcagttttttgattgtccggtgatctttgccaagaagaacaagacccgcaacatcgccggcgatgtctacacctccaaggtggagtcctttacccacggcaaggtgtacgacatcatcgtgtccaaggagtttctgcaccccgaggaccgggtactgctcatcgacgactttttggccaacggctcggccctgcagggcctcatcaacctggtgcaggatgccggcgccaccttggtgggtgcgggcatctgtgtggagaaggccttccagcccggcggcgacctgatccgcggtatgggagtccgggtggagtccctggcccgcatcaaagccatgagcgtggagggcggcgtggagttctgctgagcccacagctccagccgccgcatcccgtaggggcggcccttgtggccgcccgccgggagggcggaggaaagaaagcgaagagaaaagcggaggcgggcgcctccgccggatgaaccgaggtcttacggttcgtcggggagcctctgggctcctgtcttacacagcaagaccggctgccgcaggcggaggacgtccctccgtgatgagcggatgattttggcgttcggcgcgtatggcgcccgtcggtgagcaggggggagtgcccccgtgttcaggcagccgttttgaatagaggacccgattgattgagagacgcaattaaggaggaacttaaacgatgaaaaagagactgcttgcactgctcctggcgggcgctatgtctgttggactggccgcctgcggcaacagcggggacgagggctccgccaacaccccggccggcggggagaccaccccggtgactgacggcactggtgagccctccgccgagggtaaaaccgtcaaggtgggcatggtttgcatcggcgacgagaacgaccagggttatacctataactttatgaaggccgtggaggaggccaccgcccagttggccgagcggggcattaccgtggagtggagctacaagaaaaatatcctggaggactccggctgcgaggacgccaacatcgagctggccgaggatggatgtgatattatcatcaacaactcctacggcttcgagccctttatgctgaaggtggcccccgactaccccgaaatcgagttcatctcctgtaccaaccaggcctctgccgtggacgatctggacaacacccacaacgccttcgccaacatctacgagggccgctacctggccggcgtggccggcggcatgaagctgcagcagatgatcgacgagggcaccatcaccgccgaggaggctgtcattggctacgtggccgctttcccctttgctgaggtggtttccggctacaccgccttttaccagggcgccaagagcgtgtgtccctctgtcaccatgaaggtcaagtacgtcaactcctggtccgacgcgccccaggaggccgccgccgcctccgccctggccgacgagggctgcgtgctcatttcccagcactccgacaacaccacccccgccacctccgcccaggacgccggcgtgttccactgcggctacaacaacgacatgaccggcgtggcccccgaggccagcctcatctcctgccgcgtggactggacgccctatttcgtctatgccatctccgccgtggccaacggtgagagctttgaccaggactggactgccggctacgccgatggctccgtcaagctgaccgagctgaacaccgccattgccgcccccggcactgaggaggcgctggaaaaggcggaggccgatctggcgggcggcctgcacgtgttcgccggccccctgtccggccacccggcccagaatcctgacggcgaggtgtggagcatcggtgagggcgagttcttccccgaatccgacctgagccaggagggcggcctgtccgcacctcagttctgctacgtcatcgacggcatcaccgaggagtaaacaaaagatcaaaccggaagcaaaggcggggccggcccaggcgggccggccccggatttctcccccgcgaccgcgccgggggcctttgccgcaaggagtagcgagtgagagagaagagaacgcttcggccccgcgggggccgggaaaggaggctgggtttggaacaggtcagcgcgatccagctcaaggggatcaccaagcgcttcggcagcgtcgtggccaacgacgggattgatctggaggtgaagcggggggagatcctctccctgctgggggagaacggaagcggcaagaccaccctgatgaacatgatctccggcatctacttcccagacgagggacacatctgcgtgggcgggagggaggtcaccatccgctcccccaaggacgcctacgccctgggcatcggcatgatccaccagcacttcaagctggtggacgtgttcaccgcggcacagaacatcgtcctgggcctggaggggaagggggccttcgatctccgggccgccgcccgccgggtgaaggagatcagcgaaaagtacggctttgacatcgatcccggcaaaaaggtctacgacatgtcggtgtcggagaagcagacggtggagatcctcaaggtgctctaccggggggcggacatcctgattctggatgagcccaccgccgtccttaccccccaggagaccgaaaagctcttcgccgtcctgcgcaacatgcgcgctgacggcaaggccatcgtcatcatcacccacaagctccacgaggtcatggccctctccgaccgggtggccgtcctccgcaagggcaagtacatcggcaccgtcaacaccgccgacaccgatccccagaaactcaccgagatgatggtgggccgggcggtgagcctgaacatcgaccggccggaggccaagtaccgggatctccgcctggaggtcaagggcctgacctgccgggatcacgagggggtcaagaccctggacgacatgtccttccaggccttcggcggcgaaattctgggcatcgcgggtatcgccggctccggccagaaggagctgctggaggccatcgccggcctccaggccgcagaggcgggcagcgtgctctattacccgccccaccccaacagcgacatcgccggctaccacgtccccgtagaccgggacggcgaggagctggtgggcaagacccccatgcagatccgccgggtgggcgtgtccctggcctttgtgccggaggaccgcctgggcatgggcctggtggcgggcatggacatggtagacaacatgatgctcaagacctaccgggagcacaagggccccttcgtggaccgcaaggccccccgggcgctggcccagcggctgattgacgagctggagatcgtcacccccggcgtcggcaccccggtgcgccggctctccggcggcaacgtgcagaaggtgctggtgggccgggagatcgactccacccccaccgtgcttatgaccgcctaccccgtccggggcctggacatcaactcgtcctacaccatctacggcctgctcaaccagcagaagatgaagggcgtggccgtgctcctggtgggggaggatctggacgtgctgctggagctgtgcgaccggatcctggtgctctgcggcggcaaggtctccggcatcgtggacggccggaataccacaaaggaagaggtgggcctctacatgacccacgtgggcggcggaaaggaggcgggcgagcgtgcatagcagcggcaaaacacccctgatccgcctggccaagcgggacggcatggccggcgcgggccagtggggcatccgcatcgcggccatcctgctggccctggtggtgggcggcctggtgatcctgctctcgggcaacaaccccatccagggctacgccatcatcgtggagggcgccctgggcaagacctccggcatccggcagaccgtgaagaacttcatccccctgctggggaccgccctggccattgccccctgcttcaagatgcgcttctggaacatcggcgccgagggacagatcaccgccggcgccatgtgcgccacctatttcgccctcttctgggccgactccatcccccaggtgcccctgctgctcctcatgtgcgccgccggcgccatcggcggtggcctgtgggcgctggtgcccgccttcttcaaggcccgctgggggaccaacgagactctgttcaccctaatgatgaactacatcatcatcggcgtggtgaagtggctccagggcggcccgtgggagaagatcccccggggcagtcagcagattgagcagttcgcctccaacgcctgcctgccccgggtggccggcgtgtactgcggctggatcgtggtgctggccctgacggtgttcatgttcctctacatgaaatacaccaagcacggctatgagatcgccgtcatcggcgagagcgagaacaccgcccggtacgcgggcatgaacgtgggctgggtcatcatgcgcaccatgttcctctccggcgccatcgccggcgtggtgggcttcctgctggtctccggcgccaacaacaccctgtactccggcgtggccgccggggcgggcttcaccgccatcaccgtggcctggctggcccagctcaaccccttcgccatggtgggcatatccgccctgctggccgtcctccagaagggcgcggacaccctcaacacccagatgggcatccccgcgtccctctccgacgtcatcaccggcgtgctcctcttcttcatgctggggtgcgagttcttcatcaactataagctggtcttccgcggcgcggaggagcgccacaagaggaaggaggcggcgaaatgacctttctgctcaacctgatcacggccgccgtcctctacggcacgcccctgctctacggcaccagcggcgaaatcctcaccgagaagtcgggcaacctgaacctgggcgtcgagggcatgatgttcatgggcggcgccctgggcctgggcgcggcgttctactatgagaagctggcgggcgcggcggtgtccgcccccctggcggtggtcatcgccatcgccgcctccttcctggctggcgcgctggccgccctgctcttcagcttcctcaccatcaccctccgggccaaccagaacgtcaccggcctggccctcaccatcttcggcaccggcgtgggccagtacatcggtgaattcatgcgggtgcgggagggcacctacgtggccgtcagcaacaccctgaagggggccttcaacggctcgcccttcccggccttcctccaggagctgccggtggtgggcaggctgctcttcagccacagcattttcacctatctgggcatcgccctggccgtggccatgggcctgtacctccaccgcagccgctccggcctctacctgcgcgcggtgggcgagtcccccgccaccgccgatgccgccggcatcagcgtcacccgctgcaagtatctggccaccgtcatcggcggcggcatctcggccatcggcggcatggtgtatatcatgaccgtggtgggcggcgtttggaaccacgagggcctctccggcgtgggctggttggccgtggcgttggtcatcttctgcctgtggagcccctaccgggccatctggggttccatcctcttcggcggcctgctcattctctacctgcgcatgcccatcgacctgatccccgaccagatctacaagatcctgccctatgtggtcaccgtgatcgtgctggtctttacctccatgcgcaacaaccgcgacaagcagccgccggccagtttgggcctggcgtatttccgggaggagcggtaagccacggatgtttacccgctttcccggctgcttggcgcggagggacccgccgcaggcgggacgcgccggaggcgcgcaggccggggaaattcagttcccccggccgcagataaaaggaatggggcccccgccgggccacaggcccggtggggaaacaagccgccgccggccagtttgggcctggcatatttccgggaggagcggtagggctctgttttactggataagagggacaaaagcagcgcccccggcttttgccgggggcgctgctttatgcaaaaaaacgacaagggccggacgtctgctcctgacgtccggccttatcgaaggaaagaggatacaatgaaatgaaaagaaactgtctcttgcgagtattataatacccgaaagatgttaacgaataaatcggaatgtgttacagaacctttaaataatttgcttcttatgtaaagcgccggtaaaatgaggcgggcagcggtgctcacccgctgcccgtcacatgattggaggatagaatgaaaagaagctctgtctcttgcaagtgttatactaccaggggggtgttacaaaatcgagcacgccttgttaaaaaagcgttaaatcagcgcaaagattgaaagaattcctggagcagagcggcgcactccgcctccagcacccggccgtagatgcgggggtggtggttgaagcgctcctcaaagaggttgagcaccgacccgcagcagcccgccttgtcatccttcgccccgtagtatacggcggggatgcgggcgttgacgatggccccggcgcacatggggcagggctccagggtgacgtagagggcgcatccggccagccgccacccccccagggtgcggcaggcctgggcaatggcctcgagctccgcgtggccaagtgcggtctgggcagtctcccgccggttgcggccccgccctaccaccgcgccgtccctcacaatgacgcagcccaccggcacctctccctccgccatggccagcctggccagctccagcgcctggcgcatgtactcctcgtgttccataaagccctcccatgttgtgccttcatatctctaattgttatagcatatccatggaaggtatgctataataaatttcactctcctaacaatattttgcagacaggtgattggtttggttgagattttcctgattgccgtgagcctggcgctggacgccttcgcggtatccgtgtccagcggcatctccatccccggcttcggtccccggcaggccgttaagatgggtctgtggttcggcacgtttcagtttcttatgccccttctgggctggctgctgggcagcagcgtcagccagtacatcgaggcggtggaccactgggtagccttcggcctgctggccgtcatcggcggcaagatggcgtgggagtccctgcgccggggctgcggggaggagggcgaggcgccccccgacctgtccgcccagcggctgtgcgtgctggccattgccaccagcattgacgccctggccgttggggtgtctatggcctttatgagcgtccatattctggcctctgcggcggtcatcggcgtggtggcctttgccctgtcggtgaccggcggcctggtgggccgccgcctgggctgcctgttccagcggcgggccgagctgacggggggactggtgctcattgccatcggtgtgaagatccttatcgagcacctgtcggggagctgagcatgggcatctgggagcagttgggcctggatatggcccgccaccggatggtggccctggtgggggcggggggcaagacctccaccctgtatgccctggcccggcaggcggcggacagcgggcggacggtggtggtcaccaccaccacccatattctgcgccaccccggcctgcccctggtggaggagccgacgccggagcgcctgcgggccgccctggaagggcacggggtggtcaccgtggggacggtcttccggggggacaagctctccggcgcgggaactccggaggagctgcgccgggcggccgatgtggtactggtggaggccgacggggccaagcgcctgcccctcaaggccccggcggagtacgagcccgtgatccccccctgcgccgacgccgtggccgccgtggcgggcatggacgcggtgggacaggccgtgggggcggtctgccaccggccggagcgggtgtgcgccctgctgggcgcgggggcggagcacgtgctcacccccgaggacgtggcccttctgctggccaacccccagggggggcggaagggcgtggggagggccatggccttccgctgtgtactcaacaaggcggacacccccgagcgggcggcccacgccagcgcggtggccggacggctggcggagcggggcattcacagcgccattacctactatcgggaggaggagcggggcggattatgctggttctgatcaagggagcgggagatctggccaccggcacggcggtgcggctgtaccgggcgggcataccggtggtcatgacggaggtggcccagcccacggcggtgcgtcggacggtggccttctcccagtgcatgtacgacggcgcggcccaggtggaggggatctccgcccgccgggcggaggacgccggggcggcccgccgggcgctggagcggggggaggttcccgtgctctgcgatccggaggcggccattttgatggagctgccctttgacggggtggtggacgccatcctggccaagcgcaacctgggcacggccatcaccgacgcgccggtggtgctggccctgggccccggcttcaccgccggggtggattgccacggcgtggtggagaccatgcgggggcataatctgggccgcctgctcacccaggggagcgccgcccccaacaccggcgtccccggcgacgtggggggctacaccacccagcgcatcatccgcgtcccggcggacggggcgttcgagccgctggccgccatcggccagcgggtggaggagggccagccggtggcccgggtggcgggccggacggcctgcgcccagctcaccggcgtggtgcgggggatgctccccgccgggctggccgtcacggcgggcatgaaggcgggggacatcgacccccggtgccgggcggagcactgcttcaccgtctccgacaaggcccgtgccatcggcggcggcgtgctggaggggcttttatactttggaaggagggcgggtctatggagcgtctgatcctctgtggcggcggccacgtgtccctggaggtggcccacatcgcccggcggctggagtttgagctggtggtcatcgacgaccggccggagtttgccagccgggagcggttttccatggccgatcaggtggtgtgcgcccccttttgggaggcgctggacgccctgggcagccgggagagcgactactatgtgattcttacccggggccacgcccacgaccgggactgcctggagcacgtgctccgggggaagtacgcctatgcgggcatgatcggcagcagaaccaaggtggcggcggtgaaggccgccctggaggcggcgggcattgcccgggaaatcctggacggggtgcacagccccatcggcctgtccatcggggcccagaccccggcggagatcgccgtgtccatcgccgccgagctggtgcaggagcgggcccgccggggtccggcggccgcgcccccggcggcaggagagccgggcgtgctgtgtaccatcaccgccaaacggggctccgccccccggggtgtgggtacctggatgctggtgcggcccgacggttcggtgctgggcaccatcggcggcggcgcggtggagcacctggccgtccaggaggcaaaggccctgtgggcgcatgggggcggcccggtgcggagacactatgatctgacccccggcgcggccgagctgggcatggtgtgcgggggcgacatcgacgtggaattcgaggtgcgcaaatgaaagaaatcaccctgtttcttctgaacaactgtccccactgcaggctggccctccggctccaggaggagctgctggaggagcaccccgcgtggcgggacatccccctccgaatggtggacgaggcggcggagcccgcctatgccgatacctttgactactactatgtcccctgctactatgtggacggcgtgaaggtgcacgagggccacgccgagcgggccgacgtggaggcggtgttccgcgccgccgccggggagcccgcgggggtgtgacgggtggggacaggcccacgctttttccgtactggcagtatgtgcgccgcgccggtggagcgggcagcagcgatgtaggggcggcccttgtggccgcccgccccggcggaggaaaaacggtaaggagaggcccgcatatgggcagacggatttcccatgggggaaatccgtctttttttgcgcggatgcgaaaccaaacggccgtccgcgccgtgttaaaggcagaaaggagggaggcccatggaggaacgctggcgggaaccggcggccctggcggagcagtacgccgggatgctctaccggctggcctacgcccgcaccggctcccgggcggacgcggaggacgtgatgcaggaggtctttgtccgcctgctccgggccaggccggagttccgggacgaggagcacgccaaggcctggctgctgcgggtgggcgcacgctgcgccgccgatgtgctccgcgccccgtggcggcggcgggaggggccgctggacgacgcgctgcccgcgccggagccgcccggggagggcggcgtggtggaggcggtgctggccctgcccgccaagtaccggacggcggtgcatctgtactactatgaggagctgagtgtggcggagatcgccgccgtcctgggcaaaagcgagggggcggtcaagtcccggctgttccgggccagggcgctgctgcggcggtatttgaaggaggacgacgatgtttcagaacgactataggcgggagatggacgggctaaggcccagcccggcggcggtggagcggctcaaccgcctgctggaggagggagcgccggcccggcggccccggcggctgggccgccgggcggccgcagccctggccctgtgcgccgccctgtgcgtcaccgccgtggcggcgggccccaccctgtgggacgcgctggaggcccgcctggggccctacgccccctttgccgcagaggtggagggggagacgtccggccagggcctccggctggagctggtgaaggcggtcagcgacggctataccgcccgggtgtactacaccctcaccgacgagacgggcgaccggctcaacggtcacacccacgtttctggacggttagaggtggacggcgagggccttaccggaagcggcggcagccaggtggtctcttacgacgctgagagccgcaccctgctgctggaggccagcgcgaagggcctggacaccagccgggccgtgtcgctggagctcaccggcgtcgaccccagcgagcgctatatccagggcgcatactttcagcctccggccgacgcccgcgcgctggacaccgacaccacgggggagggggccgtggtgctctcccccgggcagactccccagaccagccccgacaccgcggatttcaccatcagctccatgggctttgacggccaggggcgcttccacatccgcctggccatggccgagggctttgacgcgggctggctgctggcggtgccctatgacgcggcggggaagcagatgggctccacgctggagcaaaccgcggtggacggcggcatggactacaccatcggcggcgttgcgccggacgacgtggcggacatggcctccatccgggtctacggggcctaccgcggccccgaggcggccatcgagggggagtggagcctccctgtggagctggagccggcggagcagagggtgatcctggtgggccgcaccctggaggacggcttctatgtggagcgcatcgaggtgtcgggcatgaatattgccgtctactaccggggcggggacaagagttggttcgtggtgtgggccaccgataagaacggcgtccggaccggagtgcccatgggcatgatgagcgcgggcgcggaggacgggttgaacctcgggctgtggagctttgagacgcccgcggcgctggacgagctggcctcggtcacccttctgggggagaccttccccctggaataaaggggacgcaacggccgggaacaatcacccagggacggatttctttcaaagaaatccgtcccttttgcatgaaaatcccccgccaatgcgtccaatgggatagaatggagcagaggaggggagcgagatggcacatcaggcgggcagcgccgccgatctggagcggctgatggaggagtacggcacggggcttctgcggctgtgcgccctccagctgggggacgccgcactggcggaggacgcggcccaggagaccctgctccgggcgtggcggaggtacggcaccttccgggaggcggcggcggagcgcacctggattacggcgattgccctcaacgtgtgccgggatctgctccgctccccgtggcacacccgccggatggagctgtccgccctggccgagccgtcggcggaggacgcgccgtgggacgatacccccctgcgcgccgtgctctccctgccccggaagtaccgggaggtcgtgctgctgcgctactatgaggagtttactctggaggagatcgcggacacccttgggatcgcgccgggcaccgtgtccgcccggctgacccaggccaagcggaagctgcggcccatgctggaggagtggtattatgactgagctgcgcaaggcgctggagcggccggtggccggtctggtattcgacgagaaccgaaaaaatgctgtcagggaaaaggcctttacggcgaaacgggtcggttctgcgctccgacgcggcgcagcggctgcgctggtctgcgccgctctgtgcgccaccgccgtggcggcggggccgtccctgtggcagtatatgcaggcccgccagggcccctttgccgggctggcccagaccgtggagggggcggtgtgcaccagcggggggattgagatacaggtgctcagcgccctggccgacgacgtgcggggagaggtctacttcacggtccgcgacgtagagggggaccggctggacagccagctcaccctgcactgcggggcggacagcgatctggccggccggctggtggagtacgattcggagagccgcaccgccctgtttgcggctggcctgtcctattaccggccccagacggagggcgcggtgggcctcggcacaaccggcggcgccgtcccggacacgctccatctggcggtggagcgcctgaccacccggcagggcgagctggacgccggcgcctcctgcgccggggtgacggcggcccttctggacagcctgcccctgggggagggggaccgggtggtgatgggggtggaggagagcggctatcccgcctccattctgcccggcgagcgggtggtgctggcccccggccagacacccatgcccctggagggcaccggcgacgtgaccatctcctccatgggctttgccagcgacgggcggttccacgtccgggtggcctacgcccccggcatcggccacgaggatttggacatgggctatttcctcgcccgcgtctaccccagggacgagcgccggacggcggaggagaaatactggtgcgccacggtgatcacccaggtggaagggggcctggacgtgctcttccccctgatcaaagcgggggaggaggccgagctgggggaggtgtacttctacggcggctatgagcgccccggtgtggacatcgccgggccgtggagcatcgacttcccgctggagcactacccctcggcggtgctggagtggacgggcaccctggcggggcggcgggtggatcacgtcaccgtctccccccttaccgtcaccatggacagcgacgacacaggcggcttcagcacggcggagctcacggtggttctaaaggatggaaccgaggtgcccgccgcctgcggcgcgggccgctacgccaacgtgggagagggcgccggcgcggaggtatgggacgcctacaacacctgggagctggagcgcccggtggaggtggcggagatcgaccatttgctccttctgggggagcacattccggtgtcgtagcagcggaaatatgtcaaaacggatatcccaccggctcatttgccggtgggatatccgtttgtttttaggagagtgcctccgggttatccacatccaaaagctcgtttggggaaaacgcctccaccagccggagccgctccgggtggcggcggatgaccgcgccgccgccggtgtccccggtaagcgcggccagctctccaaacaggtcggcgggaaacaccactggattgcctctccgtccttgccaggagagagcgtaaatggcgtctggtgattccaaaaaggaatttttgaggcagatgatactctttgtggtcaaccagggctggtcgcagacggcaaagagcaccccctccaggtccgacatccgggccaggcccaagcgaatggaggcggagatcccctccgccgcaccgccgttatagagcggaagaaatccgaatcgttcaccagcagccagaatttgcggatagggggagcacaccactgcccggtcaaattcggcaggggccagagccgccatggcccggtggtagagcgggacgctgtccacctctgccagcagtttgttggagccaaagcgccgtccaaagccggaggccatgaggacagcgcccagccgctcaggcaaaggcctgccccaactggagcaggaggatggggacagccagcttgatcaggcccaccaccagggtcataaaggtgaacagggccagggctttgccgcggctctcaaaggtatcctcccagcgggccagcatacgggtgaagttggcggttcggttctgagcgccgatgagatcggacacgctcttaatggtgttaaaggcggtatagcccatccagacgggcagggcgaccagggagacgttgtagcggtatcccccctcagccagcaaaagatagagagccagcgcaaagctggcaagcgtaaagagcagataggcccagacgcctattttggcggagcggtcgttcatgagtgtggtttcctttctctgttggttttcagggccggatgtcctgggcggcgaaggcggcaagcagggcatccatgtcaggagagacccgcatgggctccccggcggcctgaataccgctctgcacgtccttcaggccgttgccggtgacgatgctcaccaccgtgctcccggcgggaatgaggcccagctccacggccttcttcaccccggcggtgccggccgcccccgcgggctcgccaaacaccccctgggtgcggcccagcaggcgcatggcctccaggatctccccgtcggacacgttgacggccacgccgtccgactcccggatggcccggagggccttgtccgggttgcggggcacccccacggcgatggagtcggccagggtgttctccgccatgggttcccaaggctttcccgtctcgatggcccggttcagggggcagcagccctccgcctgcacggagatgagccggggcagccggtcgataaacccggccgcgtacagatccttgaggcccttccacgccccggcgatggtgcagccgtcccccaccgacagggcgatgtaatcaggcgtctgccagccgagctgctccagaatctccagggtgacagtctttttgccctcggagaggtaggggttgatggcggcgttgcggttgtaccagccccagcggtcgatggcggccctggacagctcaaaggtgtcctcataggagccctccacgctgatgaccgtggcgccgaagatccgcagctgggccaccttgcccctgggggcgcggctgggcacaaagatgtaggtggacagcccggccgccgccgcattgcccgccagggaggaggcggcgttgccggtggaggagcaggcaatggtgtccgcccccgcctcccgggccttgacgaccgccagggcggaggcccggtccttgagggaggacgtaggattctggccgtcgtccttgaggtagagggtatccagccccagggcccgggccagccggtcggccttatagagaggggaccagcccacccgcaggggcggggggacggactcctcctccaccggcagaaggggccggtaccgccacatgctgtagtcgcggcagtccgccagagatttgggggagaagtgccgccggatggcggcgtagtcgtatacgatgtccaggatgcccccacaggcacaggtagtcagaccgggcgcggcggggtactcccgcccgcatttgacgcacttggcgcccaggacatatttcataaaatccccctttcggatgtgggacggcgggccgatgagggcatcagcccctacacattatgagggtaacggctgtagggggcgatgccctcatcgccctgcttgccccggtttacaggcgcttgagcaccccggtctcctcgttgaaggcggtgatcagctcatccagggcggcggcctgccggtgcacgtcgtcccaggtactgccgtaccagaggtcgttgagctcgtgcatgtcgcggccctgctgctccacccaggtgtagtatttcagattgtgcacccgcttgcggtcgtagtagttcagctccgccatggcgtcggtgcgcaggcccagcagatggagggcgtggtccaccgcggcggcccgcccgtcataggggccatactggtcggccagctcctggatacgggagcggtacatgtccgccgagtcggtgaggacggtggccaccacgtcgtgctccgtcagctcgtagtacttggacagcttcacgcagcacagcacgttggcgatgccggagatacccagcagggagagctgcgacagggtctcctccggcaccccggcctcccgcaggtagtcatggccggccgggtcgttaaacagccgcagcagccgctgggagtcctcgtcgtcgatgtcgatgaccatgtcggtgttcttcacattgtggatccaggggatgtgcttgtcgccgatgccctcgatgcggtggtcgccgaagccgttttccagaatggtggggcactgaagggcctcgcccaccgccagcttcaggccggggtagacctccttgaggtagtcgccgcagccgatggtgcccgcgctgcctgaggtgaagcaggccccggagagccggtcgccggggcgcttgaccgcctcaaagacctcggcgatggcggagccggtgacctgatagtgccacaggtggttgcccatctcctcaaactggttgaagatcatgcagtcgggctcctgccgcagctcgtgggtcttgtcgaagatctccttgacgttcgactcgcagccgggggtggcgatcacctccccggcgatctgggagagccactcgaaccgctcccggctcatgcccgccgggaggatggccaccgatcggacccccagcagcttggagttgaacgcgccgccccggcagtagttgccggtagagggccacaccgcccggtgatacccggcgtcgaactgtccggtgaccagccggggagccagacagccgaaggaggcccccaccttgtggcagccggtggggaaccacttgcccaccagggcgatgatgcgggcggacacgccggtgagggcggggggcagctcgatgtagttgggtacggcgcggtacagtccaccggattccatgggctcgttcttccaggtgatgcggaagagattcaggggggccacatcccacaggcccacgcccctcaggcgggcccggatgggctccggtaccgtctccgggtgcttcatgttctcgaaggtggggatgacgacgccgctctcacgggccttttggatgttgcggtccagtgcttggcggtggatggtcaggtcgatcatgcaaaagcctccttactccgaattgccatactcccatgatagcacaaggcgggcagaaatcaagcgcaattcgcgccgggcataagagaagaggggcgctgcatctgtgcagcgccccccgagctataccagggatcagtccgcggaggagaaggactgggaggccaactccacgccggcggcgtcaaaataggtgacgaccaccaggacggtctcattggaaacggacttctgcacatccttggcggcgtccacgaaggtctgggcggtttcggccagtcctgcctccagggcctcggcatacacggagcggtcgtcatcggtggtctcaatggtggtcagggtgagatcgtagtgcagctcatcgccctcggcgtacattttgagctccatcccctgggattcgtactgctcaacggaagaggtgacaagcttctgcatggtgtcggtgttgaaatactcctccaggttctttttgccgcaggcggacagggtgagcatcatggacagggccaggcaggcggccatggcaagggacagaatgcgttttttcatttggttttctcctctcagtcggatgatatggcaatgcagatctcctgcacagtgcccgaaggcaggcatccaaaggcggacgccgcggtggggccgcgtattttgggggagttgaaccgggtaagacgcggcggagggggatccggggacagaacggcatacaaggaaataattctactgacagtataacacagcagagacatatattcaacaccttgtagataagaataaaaccaaatgttttttgccattcgataaaatagggtagcaggctaagggtggaggttggatggatgaaagacctaggggagcggatcaaggaatatcggacctcaatgaagatgacccaggccgattttgcctgccgtctgggggtgaccggagcctctgtgtcggcctacgagaacgggacgcggctgccctcctatgatattctgattcggattgcgaatattcttggagtgagtaccgattcgctgctggggcggcgggggatgggcagcgtcaccctcgatgtaagcaggctgacccaggagcagagaggtatccttcagagaacagcagacctgtttgccgattacaaccgtctgtcgggcggcggcgtatccggggaaaaagaggagcaaaaggggagctgacggctgtcagctcccctttttggagcgaaaaagggagctgcacaggtgcagctccctcggtgcgtaccgggttcagtccgcagaggagaaggactgggaggccagctccacgccggcggcgtcaaaataggtgaccaccaccaggacggtctcattggaaacggacttctgcacgtccttggcggcgtccacgaaggtctgggcggtttcggccagtcctgcctccagagcctcggcatacatggagcggtcgtcatcggtggtctcgatggtggtcagggtgaggtcgtagtgcagctcgtcgccctcggcgtacattttgagctccatcccctgggattcgtactgctcaacggaagaggtgacaagcttctgcatggtgtcggtgttgaaatactcctccaggttctttttgccgcaggcggacagggtgagcatcatggacagggccaggcagatggtcagggtcagggaaagaatgcgtttctttgcggtgttcatgttataagctcctctcagttatttggtacggattttatggatatgtatggtatacatagatcccgtcagggcgtgggtgtgtgtgcttcgttataggctttgttctgctgaatgcccccaacgataaacagaatgggggctgcaacgccgcagaccagggaagcaacaccgttgggggtaaccaccccggtcagcagggtgccaataccgccgatgaccagcagtgggattccccaacccaggaaaaagcggtatttttctggccgccggctccgggagagccccagaataccaaccgtcagatcaatgatcagcatgattacggcaatcgcgcccattacaaaaacaaatccggagaaaacagccattatctcgtcgccgccgatcaggccgtcgctctgtgcccgggccatttgatcgacatagggatacagttcggaatccatcatgctccccactgagagaaggagtccggccagcgtgacaagggcggaggcaaggccgcccacaataaacagaaggcagcctacttttaaaagagaattaggatgctcgtgcatcaaaacaaactcctttctgtttctgctttgtattaattaatagtaaattgttccactgctcaccagaagaaaggcaagggcaaagactgcggcccaggagaccaccagataggcaatactcaacaggacccggagcgcgggggccagattctcggaggtggacagccgaagggtcaggaaaatgccgagcacggccagcactccgccaacagcgccgttcataatctgcgccaggttaagggcagacaccacataagcccacaccgggattttgccgatgggggtgtagggcttgccggtgcgcagcatcacgccgtccaccaccagctccatggaccacaggccggacaccagcatcacatgggcgccggaaattgggagatccacctccatggtcagaaacagcagcttccgcgccggaagagagcggattttgtagcgcgttccgttgatttccacggagtaggatcgtaaacagatggtgtagtcctggccttgtaaagtgatatggtaggttttcatggtaataacacctttctgcaaacagtggtgctattatagcgtagacatagggtaccgtctacccagtttgccgattccgtcgtttaagaggtaatatccgtcgtttgggggtgctcgggcagataccagatggcctcggcaatgaagcggcggccctcaatccgtacctgtaaaaagccgtccagagaggacagggcccggcgtacactgtccagccccataccatgcagggaggtttctgcctttctcgttttaaagttgccctcgtgatcctgcaaaagcgtgccgtcaaaggtgttctccacacggaggcggcacaggcccctgtccgcccacagggcgagggacagctccttttgggggcaacgggccagtccctccaccgcgttatccaggagattacccaagatagtgttgacggtaaagaggggaagggaaagtcctgcggggaggcggaactctgcccgcacctgcgcccctgcccgccgggcctcggctaacttgaagttaatcaggctgtccagttcgggattgccgctgctggcccagagggccgagggctctaaacatttcgaaaactgttccgggtaaccctgcagtgctccggtgtcctgctggccggccaacagatgtagggcggccaagtggttgcgcatatcgtgccgcagggtgcggagctcccgttccccgcattggtaaagggctacctcgttggcataggcctgattctgctgctccagtatacgggcgcggtactgcgcgtaatagctgcgtcccacctgccggtagagatggaataccaggaggttgagaagaatgagcatcccatccacaagcagggacagccaggcagggcagtgggcaaagtaaaacaaaagtatgaccatggcaatggaggtagagggaatcagaagtacggcgaaccagtagaaggggccgtccggctgaagctctttttcggaagagggacaacgcttttccaacaccagggccataaaaaacaggagcagggcggataccaggtttccaagctgggaggtatgggcaggcattagcagaaagaccaatgtatccagcagaaagctggcggcgtagatgaccagcgcagaccacagcctttgccaatgcggagcacggtagagcagggagagcagcagcagggggagcagggaggaggccaggttcagcagggggacgccgaccaacagaaagcacaggctgttgagtacataggcacacaggtagcctgccgcctctgccgggcatcccaccctgcgctggcccagaaagagggtcagcaggcggcggtagaggtaccagtgaaacccgttaatgagcaggtaggaggcggtttgcaggtcggtcatagcaccatccccccgggagtccatctcagcaggcgcccccgcaccacccgccggtaggactggctgatgggcagctctgttccgtcgtccagagtgagccgatcatattggatgcggcggacatacagggtgttgaccaggaaggactggtgaatacgcagaaaaaactgctccgggagctggcgggccacagtgtccagcttgtcacggcacaccagttcatgctggacggaatgaacggtgatccgcttatggtagctttcaatatagcgtatggcctgggtcggcagggcgcggggcgtccgctccactaaaacggtaagcacggcctcttcgggacgggacaggcggatggcctgaaccacacaatccagcagctttgcctcgtctaggggcttgagcaaaaaattgagcggccgggtatcaaacagagccatagcgtactgctgctggccggagatatacaaaagctgtgtcacagaatcccgcagctcttcccgcagcaggcgcccaatggcaacgccgtccacggtatccagttcgatgtccaggataagcagcgcaaaccgggctccactccgcagggcggcagccagcgccgcaccggaatggaagggggtcagctccagttcctttcccaggggggaaccgctcagcgtggtacagacctgggtaagaatttccgggttgtcgtcacaaactgcaatcctatacaagccatatcactcttttccttgttgatcggggaaacgccttggactcctgtgccaggcagcaacacataactattgagaaacaggaaaataaccctactcttaattcggctgggtgccgcaaaaaataagggtatggggcctgatttagtggaatgcggcgcggggaaagatcgggctttccttttcctgcccggtgcggtatactggaggcataaacagaaggaggtgcgttttatggaagtcgggaggagcatcccccgcgtggacgccgccgacaaggtgaccggccgcgccaaatacaccgacgatctctgcccccgtccggtgctggaggcgaagattctccacagcaccattgccaacggctgggtcaagtccatggatatctccgccgcccaggccctgcccggggtggtgaaggtgctgacctgctttgacgtgccggacatccagtaccccacccccggccacccctggagcgtggagaaggcccaccaggacgtgtccgaccgcaagctgctcaaccgccgtgtgcgcatctacggcgacgacattgccgccgtggtggcggaggacgagatcaccgcccggcgggccctggagctcatccgggtggagtatgaggagtaccccgtggtgctggagccggagcaggccatggcggagggcgcgccggtgctccacgaggagcacccggacaacatcctggcccggatggatctccgcacgcccatgccggagccggacttccacagcgtggaggacgtgctggcctgccccgcctattaccagttccggggacactacgacacccagcaggtgcagcactgccacatcgagaaccccatctcctacgcctggatggagggggggcgcatcgtggtggtcacctctacccagatcccccatatcgtccgccgggtgatcggccaggccatgggcatcggctggggctccatccgggtgatcaagccctacatcggcggcggcttcggcaacaagcaggaggtgctctacgagcccctcaacgcctggctcaccacccaggtggggggccggtgcgtccggctggacgtctcccgggaggagaccttccagaacacccgctcccgccaccccatctccttcgacgtggcggcggcggtggacggcgacatgcgcctgatggcccgctcctgcacggccgtctccaaccaggggggctacgcctcccacggccactccatcgtggccaatgccgtcaccggcttccggcagctctatctggaccggatcggccaccactccacggcctacaccgtctacaccaaccggcccgcccccggcgcgatgcggggctacggcattccccagtgtaactttgccgtggagtgcatgatggacgacattgcccgggaaaagggctgggatcccaaggccttccggctggcaaacctcatgcccctgggctatgtagaccccttcaacggcatcacctgccactccaccggcctggccgagtgcatcgagaagggcgcggacttcatcggctgggcggagctgcgggagaagtaccagaatcagaccggcccggtgcgccggggcgtgggcatggcctgcttctcctacaagaccggcgtgtaccccatctccctggagaccgcctccgcccgcatggtgctcaaccaggacggcacggtgcagctccacctgggggccaccgagatcggccaggggggcgacaccgtgttctcccagatggccgcccaggccatcggcattcccaccgaggacgtacatattgtctccttccaggacaccgacaccgccccctttgatactggggcctacgcctcccggcagacctacgtcaccggcaaggccatcaaaaaggtgggggaggagttccgggagaagctcctcgcctacgccgccgagctgttccccgacgcatcgggcctggacatccgggagcggcagattgtggacggggcgggggaggccctcatctccctggccgacctggccatgaccgccttctactccctggagcacagcgtccatattaccgccgaggacaccaaccactgcaaggagaacaccttcgccttcggctgctgcttcgccgaggtggaggtggacatacccgtgggcaaggtgagggtgctgcgtatcgtcaacgtccacgactcggggaagctcatcaaccccgccctggcggaggcccaggttcacggcggcatgagcatgggcatcggctacgccctcaccgaggagatgaagttcgatcccaagaccggccggctgctcaacggcaacctgctggactacaagatgcccacctctatggaccacccggagctcaccgccctgttcgtggagaccgacgatccctccggcccctttggaaacaaggctctgggggagccgcccaccatccccgtggccccggccatccgcaatgcggtgctccaggccaccggcgtggcggtgaattccctgcccctgtcgccccagaagctggtggaggaatttacgagaggagggctgatctgacatgtatgacattgcatctatttattcggccaggtcggtggacgacgccatccgcgccctccaggccgatcccgccgccgtggtgatcgccggcggcaccgacgtgctcatcaagatccgggaggggaagctggcgggctgccccctggtgtccatccacgagctgggggaggagctctccggcgtgacgctggccgacaacggcgacgtggagatcggccccctgaccaccttccgcggcgtcaccttttccgacgtgatccgccgcacaatccccgtgctgggggaggcggccgacatggccggcgggccccagctccgggccgcgggcaccatcggcggcaacgtgtgcaacggcatcacctccgccgacacggcctccaccctggtggccctggacgcggtgctgcgggtgcgcggccccaagggcgagcgggaggtgcccatctcccagtggtaccagggggtgggcaaggtggccctggccccctatgaactgctggtgaagatcgtgatcccctacgacaactacgtcggctataccggccactacatcaaatatgcccagcgcaacgccatggacatcgccaccctgggggtgagctgcctggtgaagctcaccagcgacaaaaaaatggtggacgacgcggccctggcctttggcgtggccgggccggtgcccatgcgctctccggccgccgaggcggcggtgcggggcctgcccatcggggaggccgtcgccgccatcggcgaggccgccctggccgacgtgaacccccgcaccagctggcgggcgtccaaggagttccgcatccagctggtcaaggagctgtccgcccgcgccctgcgggaggcggcccggaagggaggggccgacgtatgatcgaagtgctgcgctgtaccgtgaacaacaagcctgtggaggtgggtatcgacccccgggagtccctggccgacgtgctgcgggagcggctgggcctcaccagcgtgaagaagggctgcgaggtgggggagtgcggggcctgcaccgtcctggtggacggcacggccatcgactcctgcatctacctgggcgtgtgggcccagggtaagagcatcctcaccgtggagggcctccaggacgcagatgggggcctgtcccccatccagcgggcctttgtggaggaggccgccgtccagtgcggcttctgcacccccggcatcatcatgtccgccgtggagatcgtgggctccggcaagcagtacacccgggaggagctgcgcaagcttatctccggccacctgtgccgctgcaccggctaccagaacattctgaacgccgtggagcgggcggtggacgaggcccacaggttcgtgggaaaaggggaataaagacaaacgggagacgcctgtcgggcgtctcccgttttgtgggccgatgagggcatcggcccctacgggccgtgcggaattggatcccaatacgtgcatacctggtccggggttcggatcttgcgccgtggacaatgacagtgcccgtaccaaagggggaaatagctgccatcccggtaaatatagtgctgccggtagtggacgcaagtcccgcatacctgtccgtctacaatttcatatttatacatccttatcacctaagactattttatgcaaaaaatgcataaaatgcaatatgcagtttttgcatgatatatgctgattaccggtgatgcttatgtacccgcgattggcggaactgcgggaggatcatgatctgtcccaggcggaaatggcaaagatattaagggtcagtcaggccacctattcccggtatgagaccgggcgtttggatattcccagccagacgctgattgctctggcccggtattatggggtaagtgtggattatctgctggggctggatcacaggcggtaggggggcggtacccgcatcgccccgcccggacgaaaaaaagacctgcggcatttgccgcaggtctttttgacaatcagcacatgggcttcaggtcgggggagacgatcagggtggcctcggtggcggcctgtacctgctccacagtgaactcggggttgatctccaccagctccaggcccttgtcggtcacgttgatgacgcacatctcggtgatgatcttggtgatacagtggacggcggtgtagggcagcctgcacttcttcaggatcttggggttgcccttggcggtgtgctccatggcgacgatgacttccttggcgcccaccagcagatccatggcgccgcccataccgggcatcttcttgccggggataatccagttggacagggagccctcctcgtctacctccaggccgcccagaatggtggcgtttacatggccgccgcggataaagccgaaggaggtggcggagtcgatgtagcagccgaagggagcggcctgggcgggctgtccgccggcgtcggtcttatagcgggggtcggcctcctcgggcgtgggcttggctccggtgccgatgatgccgttctcggactggagaatcacatgcaccccctcaggcaggtaggcgggtaccagggtgggcaggccgatgcccaggttgaccacgtcgccgtccttcagctcctgggcgacgcgcttggcaataaagcccttgatctcagacttttccattacgcattccctccatccacgatgtagttgacaaaggcgccggaggtcacgacgttctcaggctggatgtcgccgatctccaccacattgtccgcctcggcgatcaccacgtcggcggcggtggccatgacgatgttgaagttgcgggtcgtgcccttgtaccagatattgccgaacttgtccacaaggtggccgttgatgagggcaaaatcggcacggatgggcttcatgagcagatagtctctgccgtcaatggtttgcttgcccaggcagaagggggaatcctccacgatggtgcccacgccggtgggggtgagcacgccgcccaggccggcgccgccggcgcggatcatctccgccagagtgccctggggaatcagatccacggtcagggtcttgtccaccatgccctgagtgcccacgtcgggggtcatgcccacgtgggtggcgatgacgtgcttgacctgatggttgtgcaccagcttggccacgccgtagaattcctcgccgttggggccggtggccatgccgcagtcgttgccgatgatggtcaggtccttggtgcccttctgagccagagcttcgatgatgtgatgggcgctgccgcagcccaggaagccgccgtacatgatggtcgccccgtcggggatcatgtccacggcctccgcaacagaaataatcttattgcgcacagtgttaccctcctagttcaaattagagtggggtgttcgcgttatagttgggaggaaggacggtccgccgcccttgctcccgcttagtttagcacttttcgaagatggtggcaacacccatgccgccgccgatgcacagggtggccaggcccttcttggcctcgggccgtttggccatctcatggagcagggtgacgatgatgcgggcgccggagcagccgacagggtggccgattgcgatggcgccgccgttgacgttgaccttctccatgtcgaagcccagctcgcgggccacggcgatggactgggcggcaaaggcctcgttggcctccaccagatcgatgtcctcgatcttcaggcccgccttgctcatggcctgacggctggcgggcacggggccgacacccatgatcttgggatccacgccgccgtggccccagctcaccagcttggccatgggcttgaggccgtacttctccacggcctccttggaggccagaacaatggcggccgcgccgtcgttgatgccgctggcctggcccgcagtcacccgctgcacatgcttgtgggcgtcatccgcgtgaacctgggtgggctcaaaggtgtggacaatctcgtcctccacgccctccggacccacggggaaggcgcccttcagcttggccaggctctccacagtggtgccggcgcgggggaactcgtccaccttgaactccaccatttccttcttcttcttgaccatgacgggcacgatctcgtcgtcaaaccgtccggccttctgggccgcctcggtcttctgctgggaggcggcgccgaaggcatccagctcctcgcgggtgatgccccacacgtcgcagatgttctccgcagtggtgcccatgtggtagttgttgtaggcgtcccacaggccgtccttgatcatggtgtccacgaccttcttgtcgcccatacgggcgccccagcgctcggcggggagggcgtaaggggcggcggacatgttctcggtgccgccggccacgatgatgtcggcatcgccgcacaggatggcgcgggcgccctcgatgacgctcttcatgccggagccgcaaaccatgcccacggtgtaggcgggcacggagtagggcaggcccgccttcacgcccacctggcgggcggggttctggcccagggcggcggtgagcacgcagccgaacatcagctcgtccacctgctccggcttcactccggcgcggttcagcgcctccttcaccaccacggcacccagctccgttgcgggggtgtccttcaggctgcccccgaaggagcccactgccgtccggcagcagttgaccacatacacttctttcattgcagtaaacctccagatcgtaatttcattttctccccataccgaaaaatacccttcggctttgattatacccctccgtttttaaaaaatcaaccactggtaaattggtaagggcaggttttttaaaaaaacaaaaccgggcggttcgggttttgccgaaccgcccggcctttctcagccgcgccccgttgtggattgggcgtagacggcgtcctccttctgaatctgggcctgggtgaccagcgtgccgtccagaccgcaggcctggagtacggccagggtgtgccgggccccggactggagggtgatgcagaccgtgtagccgtcctcctcctcgccgccggcacgtccggcgggccggaactccaggtatagatcgttgtagtagcagttttccagccggtcccggttctccagcaaatagcggcggcccagggtaccctcggccagatcggcgcggacagcctcctccagtccggtcagggcggaggcggggacaatcgcactgtccgtatcggggttggtgagccaggcgtccaccagccggtctccctcctgctgcgcgtggaagtaagattcaccagccaggccgggggcgttgagcagggcgtccagccgggcggcgggggtgcccggcgtgtccagctcggactggctgaggggaacccggtatttccgggtcagataggagccgtccatgagggtataggaaatgtccacataggtccagccgtcggactggatgctcaggccgctgccgtcctctgaccaggtgctctcccagcccacttcctccagctcctccttgtgcgttacaatggactggtgcaggccggtaagggcttccagctcctccggggtgtccagggtgagggtggcgtagcccaggtcgtcatagggggcggactccacgccggacaggtgggcgctctgtacctcagcggcgtcgggcacccggccctcaaagccggttatatcgaactccatcgcgcacatggcggccgtcaggcagcacagaaagaccacgcagcccttccacgcgccccggaatacccagaagctcttgcacagcagcatctcggccacaaagcagcccgccgcgccccacaccaccatgagaaccaggagcgtccacggcccgcggggcagcagagggtccaaaacgtagtaaaagacagtgctcagtgtcacagcggtgcagaaggccacaccgtatttgaacaccgggcgcacccagcggacgctgaccacgtcgccggcgctctccaaatgccggcggcggtaggccgccagggccagccctgccagcaccagcccgatgagggcgtacagggaggcatagcccagaccggcaaagtagggatcgcccagcatgctgtttccggcggcgtccgttatggtatcatactggacgtgacaggcctcggagagcagcagcaccggggtgagccagacgcccagcttctccagccaggcagcgctggtgaagccgaagagaaattcctcggccatacggctgaagacccagcacagcccggcggccaggccattgagaaccacatagaaggcgggcagggccagcacgtggccggtgaacatggcgcagaacacggcaaaggagtagaagaagagcccgaacaggctcaccaccaccagccaggtgaacaggctgctgaacaccactgtgccggcaaagacctccgccgccagggccagcaggaacaccgccagattgggcagcagcaggaacagaagccccgacaggtagttggtgaggaacaggccctcccgccgcaggggcagggcgtgaagcatgcccaccgagcggctggcatagaggtaggagaacaccgccatggcgcacagcaggccgaacagagcggtcagcgtaacggcggcgctcgggccgccgtccaggtagttcaggggcaggctgcgggccattcccccgtcccaatgtatccggttggacagaatattgaggggcagcaccgccagccagaacaggccgtacagcgaccagatgggccagaagcgggcgaaattcttgcgcagcagggtaaaattaaagtacgatgtcgcggaccgcatagtcctcacctcccagctcatagataaagatctcctccagggtcaggggcagcgcctccatcagaatgggggcgaaggcggccagacggttggtgatctcggtggcgttgccccggatgatgagggtgtggatgcgccccacctgggagacgtggagcacctggaggtccccgggaagctggggcagctccttctcctgaaacaccacctgcatcttgaccacgttctcctgcagggcgctcaggctccgctcaatgagcaccttccccctggagagaatgcccacatggtcgcacacgtcctccagctcccgcaggttgtgggaggataccagcactgtggtgccgtggtcggccacgtctcccatcagcagggaccacacctgccgccgcatcaccgggtccaggccgtccaccggctcgtccagcaccaggatgtccggccggcagcacagggccagccagaaggcggactgcttctgcatgcccttggagagccgccggatgggctgcttttccggaatggtggtaaacacgtccttcagcgcctcgtagcgcttgacgtcgaaccggggatagaagccccggtaaaagcgcatcatgtcccgggtggaggcggagaggaaatagtaaagctcgtcggggatggaggcgatgcgggacttggccgccgggttttcgtacaccgggttgccctcgatgagcactgagccgctgtcctgccggtagacgccggtgacgtggcgcagcagggtggacttgcctgcgccgttggggcccacaagcccgtagatggacccgtggggcaccgtcatggtcagtccgtccagggcccggaacccgtcaaagctcttgaccacattttttgcttcaatcatagctgcgctcctctctcacagtctgccgggccgccgcctccagccgcccggccagctcccccgcggtcatgcccaggaacagaagctccgccgccgaggcgtcaaattcccggagcaggcggtcccttctggctgcattcacgtcggcctggggggcggcgaaggagcccttgcccgccaccgtgtagagatagccctcctgctccagggactcataggcccgctggatggtgttggggttgatggccagcgaggaggccagcgcccgcacggagggcagtttgtctcccgcctggagcgccccggtcaccaccagatggcgcaggccgtccctgacctgctcgtagatgggccgcgcatcccggtaattgagttggatcataccgtcgtctcccttccggaaactgtattacatgaaataatacacttagtatacacgccgccggagggaaagtttttaattatttctgacgtttttttaaaacagcccgcagtcccggggcagaatccgccaaatttccagtgacaacagggcgggataggcgtataatagaaccaccttatcaagagaaagcgggtgacacccatgaaccagagggcctggatggagtaccgtgcctgtgtggaggagctgctgttttcgtctcaggtgcagcatatgaagtccatccggcaccaccccggcgtgtcctgctatgagcacagtgtctttgtgtcctatgtggcctggtatctggcggaccggtggggggccgacgcgcgcaccgctgcgcgggcggggctgctccacgacctgtatctctacgacccccgcaccctgccctcctaccggcagtgctttgcccatccggtggccgccgcggagaatgcggccgcgctgtgcggcggcctgaccgcccgggagaaaaactgcattttggcccacatgtggcccctgtcccgccgggcgccccgcagccgcgaggcggccgcggtctgcctggccgacaagctgtgcgccacggctgaaatcatgcagatctggcggaacctgggcctgcgccgggcggttttgagcggcgcgtgagcaagcctgtctctgacaggcttgcttttgttttttaaatggggacggcgaggggccgttttgcaaagaaaggaacggaaaaaagggcgggaaattgtgcaagcctcccaagagcgaaaaattacccgctttttttgaaatttccgatgcattttcagtcctgctttgctataatctgattgcaagaaatccatgtttttgaggtgatttcaacatgaacgcgactggagcggtcgtattcctgccacgggagggcaacggcccgtccctgatgctggaggagctcctcttcgatcccgcggccctgtggctggcggagtcgctcagggccgccggagtggagcggtttttcgtggtctgccacaccgacgaccaggcccgggcggcggcctgcttccccgccggcaccgagtttgtcaccggcggcagcggcgacgcggtggagcagctgtcggcttttctcaacgccctggagggcaaggtgatcgtgatcaccaagccggtgctgctggactggggggatgcccggacgctggccggcctggagaacggcggcgtactcgacagcaaggacaccggcgtgtaccgcatcgacggcggcctgctgtcccagactctggctgagggcgttggcctggaggaggccctgaaggagaagggcgaccgcttcaacagccgcggcgtctggttccagggcgcctatcccatccgctccggctggaacggccgcatggaggctgagatggtggcccggcagcacggtgtgcgccgcctgctggaagccggagtccgcattatggaccccagccattgctatgtgggtccccgggtgaaggtgggggagggcactgtcctgctgcccggcacgatcctgcggggggagaccatcatcggccgggactgcgaggtgggccccaacgccatggtgcggggctgcaccgtgggagatggcgtcaccattaacgcctcccagctcaatgagagcaccatcggcgacggggtgaagatcggccccttcgcgtacatccgccccaactgccacgtggggcccggcgtcaaggtgggcgactttgtggagctgaaaaactccaccatcggcgagggtaccaagatctcccacctgacgtacgtgggcgactccgacgtgggcggccacgtcaatttcggctgcggcaccgtcacggtgaactatgacggcaccagcaagttccgcacggtcatcggcgaccatgcgttcatcggctgcaataccaacctggtggcccccgtgcgggtgggggagggggcgtacaccgctgcgggcagcaccatcaccgacgaggtgcccgccgattccctggccatcgcccgcacccgccagaccgtcaagaagcagtgggccgccaagcggcgcaaccgcagaaagtagctctttcccgcagccgcgggatacaggatagagaaaaaatgtgagaggatgttacaagaatgatcgcacacggtaaggacatcaagatcttttccggcacttccaaccgccccctggccgaggccatctgcaaggaggtgggcacggagctgggcaacgccgaggtgggcgccttctctgatggggagaactttgtctccatctatgagaccgtccgcggctccgacgtgttcgtggtccagtccaccagctccccggtcaacgacaacctcatggagctgctcatcatgatcgatgccctcaagcgggcctccgccggccgcatcaccgccgtgatgccctacttcggctacgcccgccaggaccgcaagaccaagccccgcgaccccatctccgccaagctggtggccaacctgatcacccgcgccggcgccgaccgggtcctcaccatggatctccacgccaaccagattcagggcttctttgacatccccgtggacaatctgctgggcaaccccattttcaccaactatctccacgaccgctttaacggcagggaggacgaggtgatcgtcgtctcccccgacgtgggcagcgtggcccgcgcccgcgccttcgcccagaagctgggcatgggcctggccatcgtggacaagcgccgccagaaggccaactcctccgaggtcatgaacatcatcggcgacgtccggggcaagaaggtcatcctcttcgacgacatggtggacaccgccggctccctctgcggcgcggcccaggccctggtggagctgggcggcgcggtggacgtcatcgcctgcgccagccacggcgtgctctccggccccgccgtggagcgcattgagaagagtgtcctcaaggaggtctacttcctggataccgtgccccccaaggctggcgtcgcctgcgacaagatcaagtatctctccgtggcccacatgtttgccgaggccatcgagcgcatctacgaggaagtgtctgtctcgaaactctttgtataagacggacaggatagtacaaatatggcggggggcggagcgttgctccgcccccattgccgcatggaggaaaaacgttgttttttgacaaaaatcggggcgccagggctgaatggctggtggtgggcctgggcaaccccggcgaaaaatatgagaatacccgccacaatgtcggctttctcaccgtggacgagctggccgagcgggcccgggtgcccgtgcagaagctgaagcaccgcgcccttaccaacaccttggaggtggggggcgtcaaggtgctgcttatgaagccggtgacctatatgaacctgtccggcgaggcggtgggggaggccgcccgcttctataaactcccaccggagcgggtgctggtcatctctgacgacgtgtccctccccgtgggcaagctgcgcatccgcaagggcggctccgccgggggtcataacggcctcaagagcatcatccagcacctgggtaccgaccagttcccccggatcaaggtcggggtgggccagaagccccaccccgactacgacatggccgactgggtgctctccaaattcgccggggaggatctcaagaccatcacagaggccatccgtaaggccgccgacgcggtggagtgcctcattcaggaggggccggacaaggccatgaaccgctttaacggctgaggagtgcgccatgatcacctttcgggaaattgataaaagcaactatatggaatgcatctgcctaaaggtgaaggacgagcagcgcggctttgtggcggataacgcccgctccctggccgaggcccggtttgaagagggcctgtatacccgggccgtctattccgacggcgtcatggtcggatttgtcctgtttgattatgacccagagcttcccgggtggtgcatgagccggttcatgatcggcgcgcagtaccaggggcggggcctgggcaaagaggccgtgctccgctttctggactttatgagggaacacatgggggtgcgggagctctacctccatgtggagctggagaatacggcggcctatgagatgtatcaaaagctgggcttccgcgccgtccgggagatccagtatacctttgacggggcggtctaccgggagcggcggatgaagatttgcctctgagactccccgccgcccatcccacgccgggcctccgaacggcccgcgcccacaacttccgatcttttctgtgccgaggtgtcctatgaagccactgctctccgccctcaacgacatacctgaataccgctccctgctggcggccatcgacaacggggcctgtccggcggccttttccgggctgtcggcggtgcaccgcgcccattttgccgcgggcatccgccaggagctgaaccgccccgtggtggtggtgtgcgccgacgagggggaggccgagcgcatggccagggatctggccgccctgtcgggggaggaggtgcgcacactctctgcccgggagttcaccttccacaacgccgcggtggtgtcccggcagtacgagcaccggcggctgtccaccctgcgggcgctggcggcgggggagtgccccctgctggtctgtacggtggagtctattctccagcgcaccattcccaaaaccctgctgacccaggcggcccaggttctgcggatgggagagcggcacgacctgggggagctggccggcaccctggccgccgcgggctacacccgctgcgagcaggtggagggcgtgggccagttcgccctgcgggggggcatcctggactttttctccccggcccaccccaagcccgtccgggtggagttcttcggggacgagatcgacgccatgggcctcttcgatcccgacacccagcggcgcatcgagaatctcggcgcggcggagatcctgccggcggcggaggtgctgccccagtttacccctggcgggtacggcgggctgctggaggggctggaccgtctcatttcccaggcaaagcgccgcaaggggaacgagacactggtgcagacgctggaggaggaccgggagcggctggcggccagcacggccttcccggccatggaccgctacatcgccctgatctaccccgtcatggccacggcggcggattacttccccgaggacgcggtggtggtgctcagcgagagcccccgggtggccgagcggggaaagagctacctgtggcagttgggagaggacgccaaggccctgatggagcggggagagctggccggggagctggctgacttcgcccgcacctttgaggagctgaccgaggtgttggccgactggccggtctgctacctggacgccttcacctcctcccggtacccccagcggccccgcaccctgctcaacctgctgaccaagcagctcccctcttacggcgccagcctggagaccgccgtctccgacctggcccactatgtctccgacggattccgcaccgtggtactggtgagcagcgagcagcgtgccctcaacctccaggccctcctgcgggagcagaagatgaccaccgccgtggatttccagctccacgagctgcccggctacggcaaggcggtgattgccgtgggggggctcaccgccggcatggagtacccggtggggcgcttcgccgtgctcaccgaggggcagtccctgctgggcaaaaagcgcaggagcaagccggtgaccaaccggcagaagctgggctcctacgccgacctgtctcccggcgacctggtggtacacgagcaccacggcgtgggccgcttcctggagatgaccaagatgacggtggacggggtgcagaaggactacgtcaagatcgcctacgccggggccgacgtgctctacgtccccgccacccagctcgacctggtgagcaagtacatcggctccggggaggacgcccaggagacccgcaagctctccaggctggggggcaccgactgggagaaggccaagacccgggccaagaaggccgtcaaggatctggccaaggggctcattcagctctatgccgagcggcagcgccaacccggcttcgccttctcccccgattccccctggatgaaggagtttgaggacgagttcgagtacgccgaaaccgacgatcagctccgctgcatcgccgagatcaagcaggatatggaacaggcccggcccatggaccggctgctgtgcggcgacgtgggctacggcaagacggaggtggccttccgggccatcatgaagtgtgtgctggacggcaaacaggccgccatcctggtgcccaccaccgtgctggcccggcagcactacctgacggccaagcagcgctttgccaagtacccggtggagatcgacgtggtcagccgcttccgcacccagacccagatgaaggacaccctgcggcggctggagcaggggggcattgatctgctcatcggcacccaccgcctcttccagaaggacgtgaaatttaaggatctgggcctgctggtcatcgacgaggagcagcgcttcggcgtccagcacaaggagaagctcaaggagctgtccaagcaggtggacgtgctcaccctctccgccacccccatcccccggacgctgaatatggccctctccggcatccgggacatgtccaccctggaggagccgcccatggaccgccagccggtgcagacctatgtgctggagcacgactggggggtgctctccgacgccatgcgccgggagctggagcggggcggccaggtgtactacctccacaaccgggtggagaccatcacccgcaccgccgcccgcatcaaggagatgctgggggaggacgcggccgtggcggtggcccacggcaagatgagccaggaggagctcaacgacgtgatgacccgcatgagcgacggcgaggtggacgtgctggtgtgcaccaccattatcgaaacgggcatcgacatcgccaacgccaacaccctgatcatcgaggacgccgaccacatgggcctggcccagctccaccagatccgcggccgggtaggccgctccacgcgcagggcttacgcctacctgacctaccgccggggcaaagtgctcaccgaggtggcctccaagcgtctgggggccatccgggagtttgccgagttcggctccggcttcaaaatcgccatgcgtgacctggagatccggggggcgggcaatgtgctggggccggagcagagcggattcctgctcagcgtgggctacgacatgtacctcaagctgctggaggaggcggtgctggaggagcggggcgagaagccggagcgccccaccgagtgcgccgccgatctcagtgtggccgcctccatcccagaccgctatgtgccctcgccggagcagcggatggacctctaccgccgtatcgccgccatccgctccgaagcggacgccgacgacgtgatggatgagctcatcgaccgctacggcgatccgccccgcacggtcaacaacctcatctccgttgcccttctccgcgccgacgccgcccggaacgggatctcccagatcgaccagaaaggcgccaacctgaatttctatctggaccagttcgatctccagcgggtgtccgccctgtgcggcctggagaagtaccgctcccgcctgctcttctccgccggggagcggccctacctggccctgcggctcaaaaagggggaggacgccctgaaattcggccgcaagctggtggaggactacgccaagaccgccccggctcagacagaggggtagggcgcgggggcggactccccctgccggcggcagccggcgccgcgtgtgcggcggagctgggcgggattcacttccgcccagcgaaatgaaatgaaatggggcccccggcccgctcctggcgggctggggctgaggacgccctgaaattcgggcgcaagctggtggaggactatgcgaagaccgccccggctgagacagagggatagagcggggggcggactccccctgccggcggcagccggcgccgcgtgtgcggcggagctgggcgggattcacttccgcccagcgaaatgaaatggaacggggcccccggcccgctcctggcgggctggggctgaggacgccctgaaattcgggcgcaggctggtggaggactacgccgaaaacgcccccaaagcggaaccgtagggcggcgcgcaaaacttccggttgtatccgctggggaaatggtgtacactggaacaggcttttggaacccaaataaggaggacaaacacgcatgaacgtgaaacagtttctgtgcgccggcatgaccggggcgctgctcgtggccggactgacagcctgcgcgcccggcgcgccggaggtggacccgtccgacgtggcctatcagaccgccggtgtgaccagggacacggtgctctttacggtggatggcacagaggttaccgccgacgagtacctgttctggctgctccagagcgtggcctcggccaagcagagcggttacctggcggacgacgacgcttgggaggaggagctcaacggcgtccccacggcggagtatctgaaggaggacgcgcggaacaccagcgtgctctacaccacggtgtccaaccacgcggcggcggcgggactgaccgtgaccgaggaggagcaggccgaggcggacgctgagctggagacgctgacccagcgggtggacagctattacgggatgacccttcaggagtacctggaccagcagtgcatcagcgaggcggctttccgcaagctgaaccaggtgccctatctggcccggagcctccagacccagatggaggaggcgggggagctgaccgcccaggacgccggtctggatgccatggtggaggaggcgggctactacaaggccaagcacatcctgctggccttcccggagaacgaggacggcagcgccgccaccgacgagcagaaggccgccgtcaaggcggaggccgaccagctcctggcccagattcggaccgccgcagaccccttggcggagtttgacaaggtgatgaacgagcgcagtgaggacggccgggacgagaacaaccagctctatgcgcccgacggctacctggcctatgccggccagatggtgcctcagtttgagagtgccgccaaggccctggccgtgggtgagatcagcgagccggtggagaccgcctacggctaccacatcattctgcgccaggactttaccgacgaggagcgccagcagctccgggacagcatggcggccatctaccccgattacgccatgagcaagctgaacgagcagtgggtggaggaggcgaaggtagaggtcaagcccgcctatgagaagctggatcccaattctttctacaagaatatggtggcctttgccgagcagtggcaggaggagaaggccgccgaggaggccgctcaggcgaccgccagtcccgcgcccgagaccgggaccccggcacagagcacagagcccgcaccgggtgccaccgggagcggagcgcaatgagcacaggcaaaaaccccgccgatccggcggggtttttgattaaaaaactatagtttaaaagaaaggttctattgtttatagtaaaaatccaaagttgtgtcaatctatatctaaagtttgggacaaagggtgagacacaatggaggacaaggagaaaaagctggcgctgcaaaaggcggtgggcgagcgggtgtaccacagccggaagctggcgcggatgagcaaggaggagctggccgagcgcctgggcatctcctcccaatatgtaaatgatattgaacaggggaaaaagtgtatgtccatggcgatttttgtggagctgggcgaggtgttccacacagggctggatgagctcgcccacggcgcgcagaaggaggagcccgtgctggagcacctgctctgccacctgcgccagctctctccggtgcagcgggatatggccgttcacatgctgcatctggcgttccgggccgcccaggagctgggcccggaggagtaggcgtggcgctggagatccgggtcttggtggtggaggatgatccggagacccggatgctgacggaggcccttctgtccggacggaagggggtctgtctgtgcgcgctggcaaaggacggcctggaggggctggagctggtggagcagaccaggcccgatatcgtgctgctggatctgattctgcccgggatggacgggcttgatttcctccgcgccctgcgccgccgaagcgcgcgcccggctgtggtggtggcctcccaggcctcggagcccacagtcatccggctggcctttcagcttggggccagctactatctcataaagcccctcaacttcgactccctgcccgacctgtttcactcgctctgcctggagccccgggagcgggcggcggcggactatctgcgggggatgggcgcgtccgggctgggggtggaggccgccgcgcggacggcggccgtgctctccacgggcgcggagggggccattccgctcaaggaggggtatgccgccgccatggcggcccaaaacaccagctacgcctgcgtggagaaaaacatccgctccatggtgggcaagctccaggccggggcctgcggggagtatcaggccctcatgggcggccttccggccgaacggcccagcaacgagttctttctccgccggctggcccggcggattttggagtggtagcgccacgtttcccctgaaatcggacaggcactctgctatactgtagccagaaattggaaactacagtgagcgaggagcgagcgacatgggcgtatggcatacatacagcaccagacagactctgtctgagctggaaacggacaagtcccgggggctgagcggggcggaggcggagcggcggctggcacgctgggggcccaaccggctggaggaggggaggcggcaggggctgctgctgcgcttcctggggcagatgaaggaccccatgatcctggtgctgctggccgcggcggccctgtccctgtgggccagcggcggcgaggactggctggatgcggccatcatcctggtcatcgtggtggtgaacgcctgcatctccatctcccaggaggacagcgccgagaaggccctggaggccctgcggaagatgtcggcccccctggccaaggtggtgcgggacggggcgcttcagcggctggagaccgaccggctggtgcccggcgacatcatccatctggaggcgggggacctggtgcccgccgacgcccggattctggaggccgcctccctccaggccgatgagagcgccatgaccggcgagtccgtccccgtgtccaaggggctgctgtccgccctgccggaggacacccccctggcggagcggcacaatatggtgctcgcgtccaccgtcatcacccgggggcgggcggtgtgcgtggtcaccggcaccggcatggacaccgaggtgggccgcattgccgggctgctgctgggggagggggagggacagacccccctccagaagaagatggcggagatctccaagaccctgtccttcgtctgcctgtgcgtgtgcgcggtgatgttcggggtggggctgctccaggggcggcccatgctggacatgttcctcaccgccgtctccctggcggtggccgccatccccgaggggctgcccgccatcgtcaccattgtgctggccctgggggtggcccgcatggcccggcggcgggccatcgtcaagcgcctgcccgccgtggagaccctggggtgcgccggggtgatctgctcggacaagacaggcacgctcacccagaaccgcatgaccgtggtggacgtgtggacgccccggagcggcgaacgggccctggccctcaccatcggagccctgtgctccgatgccgccctggcctggaagggacgggagccggtgtccaccggcgatcccaccgagaccgcactggtggacgcggcggcccgggagggcctggataaaaatggactggagggggagtggccccggcggggggagctgccctttgactcggagcgcaagctcatgaccaccgtccaccagaggcccggcggcggctggcgggtgtgcgtcaaaggggcccccgacgtgctcgcccgccggtgccggctggattccgccgccgcccggcggctggagagccggaacgaggccatggcggggaaggccctgcgggtgctgggggtggcctacaaggatctggccatgctgccccgggagctgaacagcgccgctctggagcagggactcacctttgtgggcctcatcggcatgatcgacccgcccaggccggaggtgcgcacagcggtggagcagtgctacgccgcgggcatcaagccggtcatgatcaccggcgaccacaagctcaccgccgtggccatcgcccgggaactgaacatctaccgccccggggacctggccctgacgggggaggatctggactttctgccccaggaggtgctggagcaggaggtggagaagttctccgtctatgcccgggtgtcccccgagcacaagatgcgtatcgtcaaggcgtggcaggcccggggaaaggtggtggccatgaccggcgacggcgtcaacgacgcccccgccctcaaggtggcggacatcggctgcgccatgggggttactggaaccgacgtggccaagggagccgccgatatgatcctcaccgacgacaactttgccaccatcgtctccgccgtggagcagggccggggcatctacgccaacatcaagaaggccatccactacctgctctcctgcaacatcggagaaatcctcaccatcttctgcgccacggtgttccacttccaccagatgcctctggtgccggtgcagcttctgtggctcaacctggtcaccgactccctgcccgccctggcccttggggtggagccggtggaggagggggtcatgtcccagccgccccgggacgcccacgcctccctctttgcccacggctttgccttccggctggcctggcagggggtgatggtggggctgctgaccctggcggcctatttcctgggggagtatgtgctctccgaccccggcgaggcccacgccgccgccaacaccatggccttcgccaccctcaccctgtgccagctcttccacgcctttgacgtgcgcagcgagcgctcgtccctctttcacatcggggtgttctccaatccggccatgaacaaggcgtttctcatcggccttaccatgcagttggccgtcctgtgcgtgccgccccttcaggtggtgttcagcaccgttcccatgagccctctggagtgggccgtggtgctggccctggccattacccccgtggtggtgtgcgagctggccaaggccgtgagccgcggccggacccgccgtccggcgcgggcggagaaggtggagccagcctgtgcccggcgctgagccgggacgaattaagaggcggaattcccaccggccgcaggccggggggaattccgcctcttgtgctgtctgtaaacggatttatgcctgcgcctcctcaggcgcgcgctcctcctttacctcgcggatgaggatgaagggggtcagctcccgggactggcccgccgggttgtcccggatcaggcccttgagggtctcgtcgtccagggtgacggaggacgccttgcccagaatctccacgttcagatcgttggcgtccacaatcatggcctgcacgccggtggcggcctcgatctcgtcgcacaccttgccggggttctccgggatgcggatgccgaactcgccgtactcctggaactcgtggtcgtagaagccgtccaggccggacacctcctggcccaccatctcgtagaacacgccccgtttgccgaacagcttggccacgccggcgcagaacgcggcccagagcacgaacagggcgccccgctcgttgatggcgaactgcatcttgtaggggctgtccacgccgatgccggcggaggagtgggaggcgaagcgggacaggaaccgggccaggcggcccaccttcatgtccttcttgtagaccacccgcttctggcacaggccgatgatcttctcgctggaggagagcaggtcgccgggctgccacacgggcttgacgtactgctccaccaggtcgatatagctctcgcccacctggacgaaatgggtctggatggcgtggcgggcgtaggtctttccgcccacctctatggtgacgctctttccctcgtttgcgcggaattccatggcaaaaccttcttttgtgtttattgtccctcctattatagccagccgggggacaatgtgcaacctaaagttttgctgtgaagcctcaaataccctcgttctgggggatttttggcaggctgtcgaaacccttctgcaggtcggcatcggtggggatggaatcgctcatctttccgttgaggtagttctcataggcggtcatatcaaagtacccggtaccggtgaggccgaaaaggatggtcttggcctcgcggctctccctgcaccgcagagcctcgtcgatggccccccggatagcgtgggcggattcaggggcggggagaatggtttcccgcttggcaaagagcaccgccgcctcaaaaacgcgggtctgctcataggccaccgcctccatatagccgtcgtggtagagcttggagaggatggggctcatgccgtggtagcgcaggccgccggcgtggttggcggaggggatgaagccgcagccaagggtatacatccgggctaggggagtgacccggccggtgtcgcagaaatcgtaggcgtacttgccccgggtgagggaggggcaggaggctggttccaccgccacgatgcggggattccgtatcccccgcagcttgtcggccataaagggggcgatcagcccgcccaggttggagccgccgccggcgcagcccaccaccacgtcgggatattcccccagctgctccatggccagcttgctctccaggccgatgatggactggtggaggagcacctggttgagcacgctgcccagcacatagcgcttggcgccgccgctctggacggcggactccaccgcctcggagatggcgcagcccaggcttcctgtagtctccgggtggtcgcgcaggatctggcggcccacctcagtcgtgggggagggagagggggtgatagaggcgtcgaatacattcatcaccgcctttcggaagggcttctgctcgtaggagcacttgaccataaacacgtcgcaggtcaggccgaagtaactgcacgcctcactgagggcggtgccccactggccggcgccggtctcagtggtgacgccggttaggccctgcatcttggcataataggcctgggccacggcggagttgagcttatgggaaccggaggtgttgttcccctcaaacttgtagtagatcctggccggggtatccagggccttctccagctcgtaagcccgaatcagcggggaagggcggtacatcttatagacgttttgaatgggttccggaatatccacataggcggtggcgccatccagctcctggcgggcaagctcctcgcagaagatgggggagaggtcgtccacacccaagggccggagggtaccggggtggagcagaggatcgggctgctcggccatggcggagcgcaggttgaaccacttctggggcatctggtcctcggtcagatacaggcggtgggggatcttgctcatgttgatacactccttttctgtgctacaggggaaaagggtacaaaaaagcccttcgtccccaagattgtttctctgggacaaaggactgtagcttcagcctctgcggtgccacccggattgacgtataccagcgcatacgcccactcactttcacgggccgatcagcccatgctccccggataacgggtggagtccccgtcgcgctactgagcccaaaggctgttcgctgtgccctcaaaagtccattcatccgagcgctgcctgccgcgattccaccacccgcggctctctgagaggcattgataccggactactcctcttcgtcatcggtttaccgatttgatttgctacagtataacggcggcggcccggtttgtcaagctcttttttgtaaaagttgggccgggcccgccgggtgggtggattacagcaaattttaatctgagaacccttttttgacagggtgggatctgctacactgggaaaaaggccttgggaggtgccgaatatgaggtatgttaaagaatttgcggtcgtactggcgctcctgatgctggcgggctgcgccgggaagccggtacaagagtccccggtggcgacggatgagggcattccagcggggcagatctacctctacggggagatccacggaatcgccgccatcgaggagtacgaggcggagcggtggaaggagtgctacgaacgggggatgcggcacctgtttgtggagctctcgcactacacggcccagtggctcaacctgtggatggacgcggaggacgatgagattctggagcagctccaccaggattgggagagcacgctctcatccggcgccgagacgctggatttttaccgcaccatcaaggagcagtgccccgagacggtgttccacggcaccgacgtgggccaccagtacgacagcaccggggcccgttaccaagactatctggaggagcggggcctggcggacacggaggactaccgcctgaccctggaggccatccagcaggggaaaacctttgccgagcgtggctccgatatttaccgggaaaaccggatggcagagaacttcatccgggagtttgacgccctggatggggagagcgtcattggcatctatggcgcggcccacaccgacccggatgccatggcggactccgcgggaaccgtcccctccatggccgctcagctggtagagcggtacggggactcccttcacaccgaggacatctcctggattgcctgggagccccagcggacggataccctcaccgtggcggggaaggagtaccaggcgtcctacttcggggaggaggatatctccggctgggccggggactaccagtcccgggccttctggcggctggagggggcctatgaagacttcgaggactgtcccgagagcagcgatgtgctgccctgcaacgactatcccatgccgattgaggctgggcaggtgtttgtcctgggctacacccggaaggacggaacatcagagcggaagtactaccgctccgacggggaggtatggaacggcatggactgcaccacggaatttatcccggaataagctcataaaacggccgtggggccgccggatccggcggccccacggcccttctgcgcttaattcaggtgggaaaaattgtgccgctttttgcgggcatggtagtgggtgtggagcagctcgtgggagcgctgggacaggggcgcgccgaagaactcctcgtagatggtcttgatctccgggttctcatggctcttgcgcaggggcaggctccggtcgatctcatacaaggcctggatacgggcgtcccggacggcgttgttggtgccgatgggctgtccgccgccgccgatacagccgccggggcaggccatgatctcgatgaagatatagtcggcctcgccgcgctctacccggcggataagctcctcggcgttcttcagaccgttggccacggccaccttcaggggggtgccgtcgaggtcaatggtggcctccttgatggcgttgatgtcgccccgtacggcgtcaaactccagccggggcagggtcttgccggtgtagagctcgtaggcggtgcgcagggcggcctccataacgccgccggtagcgccgaagatggcgccggcgccggagccggtgcccaggggggagtcaaactcactctcgggcagcacggacaggtccaggcccacatagcggatgagcttggccagctcccgggtggtcaggacgtagtccacgtcctgatagccgtcccggcccagctcggggcggctggcctcgtacttcttggcggtgcagggcatgacggacacgcttaccacgtcgtgggggtcccagcccatcttctgggcatagtaggtcttggccaccgcgccgaacatggcctgggggctcttggcggtggagaggtggccgatgagctcggggtggtgcttctccaggtaggtgacccagccgggggagcaggaggtgatcatgggcagcttcccgccctcccggatgcgcttgagcagctcgctgccctcctccatgatggtgagatcagcggaaaagttggtgtcgaacaccttgtcaaagccaagcatccgcagggcagtgaccatcttgcctgtgacgacggcgccggcctccatgccgaactcgtcccccaggcccacccggacggagggggccacctggacaatgacgtgcttggaggggttctggatggcggcggtaacctcgttggtgtagtcggtctccacgatggcccccacggggcacaccagggagcactggccgcacagcacgcagtcggtctggtccatgggcaggtcaaaggcggtggtgaccttgaagccggcggagcggccggagtaggtcagggcggcgcagccctggacctcggcgcacaccttcacgcagcggccgcacttgacgcacttggcggggtcgcggacgatggaggggttgtcgatgcgcagcggctcgtcggaggagatgtcgggcagctccgggtggagccggttgaagcggcggcagagcgcctggagctcgcaggtgccgttgcgggcgcaggacaggcagttggtcttgtggtcggagaggatgaggtccagcacgccggtctgggcgtcgtacaccttcttggagtcggtgatgacctccatgccctcccacaccacggtggagcaggccgccgtcagcttgcgggagcccaccacctccaccatgcacatccggcagtgggccttgatggtctggtccgggtggtagcacaggtggggaatatcgatgttgagcatcttggccgcctcaatgatgcgggtgcccgcaggcacctccagcggctgcttgttgattgtgatatgtaccatttcgctcatcggacggcgacctcctcttttacggcaaagacttccgggaagcgcttcatacagctcagcagggcagactgggccgtctcacccaggccgcacagggacgcgctggacataatgtcggcaaatttcttgagggtggcgatgtcctgggcggtgtgggtaccctcggccaccttgtccagcagcagggagatgtggcggttgccctcccggcagggggtacactggccgcagctctcgtgggagaagaactcctgggtcatgcgcagaaagccgatgacgctggtgcgttcatccaccaccagcaccgcgccggagccgatggcggtgagatccgcctgacgcatgcccttgtaggtgtagggggtgtccagttgggcgggggagcagatgcggcccgacgcgccgccaagctgcaccaggcgcagggggtaatcctcgctctccatgccgccggccagatcatagacgatctcccggatggtgataccgaagggcacctcgaacacgccggggcgcttgacgttgccgcacaccgagatcatcttggtgcccgggcagtccggcgtgccctggctcttatagtagccctcgtcgtccagcagcaggggggccaccagggagagggactccacgttgttgacgcaggtgggcaggtggaacacgccgcactgcttgataaaggggggcttcatccggggccggccggcgtggccgccgatggactcggccagggcggagccctcgccgcagacataggcccccgcgccggagtagaggtggatgcggtagttcagcccggagcccaagatgttctcgcccagatagcccgccgcctcgcactgggcgatggcggagagcagccggggccgcaggtgggagtactcctcacgcaggtagatgtatccgttgtccgcccccacggcccagccggcgatgatcatgccctccagcagttggaaggggtcgtgggtgagcagctcccgatccttgaaggtgcccggctcgccctcgtcggcgttgcacaccacgcacttgtgggcgccgggtacctcccgggcctgccgccactttttacccatgtcgtaggccgcgccgccccggccctggacgccattggcggccagcacgtcggcaatgtcgcagccctccatggtcagggccttgcgcagcgcccggaagccgccgatggattcatagcccttcaggctgtccgggtcgtacttcccgaaattccgggtgatgaaacaaaccgtcttgctcatgtccgttcccccttagttgagctgctggagcatatccaggatacgctcctcgctgtccagatggccgtataccacgccgttgacccgcacggcgggggacacgtcgcaggccccgaagcaggggacctgctcgatggaaaagcggccgtcataggtcacctggcccacctccagatttaaaaggcgcttgagccgctccagcagggtgtcgctgtccttcacccggcagggggcggaggagcacacctccagggtaaacttggctctgggcttgtcgtgaagggcggtatagaaggagatgacatcgtagacctgggtgggcttcacccccaggcgctccgccacatagtaggcggcggcctccgggatgtagtgccgctccaccgcggcctccacgtccagcaggatgcccaccagctgggtgggatcttcgccatgggcggcgagaatgccgtcgattttgtccgccagctcctggtccagggtgtcggcagtctgggtaaagggcttcataaggggctcctccttatcacataaaatgaaccctgtcctgcggaggacatgggataattaccaaaaggaaagtagatagttcatctattaaactttatagtttttataaagtatatcaacatccctggaaaattgcaactggttcgtttaaatttgtataaccgggcgaaaacgggccatcctaaaaaagttcgattcagcaaaatagacaacaggaggtgtgcgccatgggcttttttggtcggaagcgtgcccccagcgtaccccatccccggaaggagccccgctttgacgggccgctgaccttggaacggctggagcagatcttccaggactgcgtggacttcaccaagcgtccggtgtccctgggggagggcggcgcgtgcacgctcaccctgtgctacctcagcggcatggtgaagatggagcgggtcagcgactacgtgctccggccgctggcccaggacgaggcgctggcccgctgcgggactccccggcaggccatggaccgcatgaaggacggggccctctacaacctgagcgcggaggagcgtacccggctggacgcggcggtgtttgatttggtgaacggctgctgtctgctcctctttcccggggaatcctcggtgctctccctcaacgtgggcaccgaggaaaagcgatccatcagctctcccagcaacgagacggtgctcaagggctcccgggacgcctttgtggagagcctgcgcaccaataccagcatcgtccgccgccacctgaaggcccccgagctgcgtatccgtgagcaggtggtgggccgccagtcggtcacgtcggtggacatcctctatatagaggggctcaccaatccccacctggtggagcaggtggccgcccaactggcggacattgacatcgacgcggtgctggccacgggcaatattgaggagtatatcgtccccgccgcccgcaccgccttcccgctggtgcaatataccgagcggtccgaccgcttctgcgccgggctggccgaggggcgggtgggcatcctcatcgacggcctgccactgggctacctggcccccggcgtgctgggggatttcctccaggcgccccaggacaagagcgagagctggctgctggcctccgccctcaccctgctgcgctacctgtgcatgctgggcaccctgcttctgcccgccctctatgtggccatggtcaccttccaccaggagatgattcccacccgcctggccctgtccatcattgccgccaagcaggacgtacccttccgctccgtctttgaggtcatcgtcctgctgctggcctttgagattctccaggaggcggggctccgcctgccccagtccatcgggcagaccgtgtctatcatcggcggcctggtggtgggcagcgcggcggtggaggccaagatcatctcccccgcggtgctcatcgtggtggccatcgcgggtatcgccgggtacaccatgccctcccaggaggtggcgggcgccctgcgcatctggcggttcctgctggccctgctggccagcgcggcgggcctgttcggcgtggtggccggcctgtcggcgctggtgatccatctggcgggcattgaaagcttcggcgtgtcctacctgaccccctttgcctcgaatgccggggagcaggtggaggggcacgcggtattccgccagcccctgccgcgggtgaagcagcgcccggcggccctggaaacccgaaaccggaggaatcagaaatgagacgcataacagccctgctgctggccggcttggccgtcctgaccctcaccggctgccgccgtgggcccggcctgttgccctatgcccgggaaatcgaggacatggagctgatgcagaccctgggcgtggaccgggccggggaggggcaggtggaggtaaccgcctccagcggctcgggcgatccggcggagggggcggccaccgtggtgtccggccaggccggcaccatcagcgccgccgtgctggggatgcagggggagggctcctcctacctctacttcggccacgtgggccagctcctgctgggagaggagctggccaggcagggggtggagcccgccctggactatattctccgggatgtggagacccggctggacaccgccctctatctggtgcggggcggcacagcaggcaaggcgatcacagcagcgggggaggacggctccgccgctgaccggctggaggcgctggcggaggacgcgggtctgctggccggttccatgccccgcaccgtaaaggacgccctctcggatctctatgcccagggggccacctttctcccggcggtagaggcggacgaggctctcaccgccgccgggtatggcatattaaaaggggacagcctggccggctgggctgagggggacgccgccctgggggtcaacctggtactgggccaggtggacgccgatatggtggagctgcccctggatggaggcggagtggcggccctgcgtgtggtgggggccaggacctccgtccgcccggtgatggacgggggcgcccttaccggcctgtccctcacctgtacgctggacgccaatatggcggaggggaatttggacctccgaacggaggaggtacacgcctccctcgagacggccctggcccaggtggaggaggcgcgcatccggtccgcgctggaactggcacaggagctggacgcggactatttggggctgctccggcgggcggccctggcccggccctggcacaaggaggcgctggaaggggcctctctgggcgcgctggagctggagctgcacgtgacggccaagcttcagcgcagctatgacgccgcccggtgagggcggcagctcaaaggaaaggcggtatacccatgcctgacgaccgaatctccctgcgccagctcctggcgctcctcttcgctgccctcctggctccgggcatcggcgtgctgccctcccagaccgccgccctggccggagaggcggggtggctgtccgccctggctgccctgccggtactgctggggctgtgctgggtgctctttgccctcctgcgcccggcaggggagggggcggggctggcccaggtcaccgagaccgtcctgggcagggggttgggcaagggggtgcttcttctttatttattgtggggtctgcttctgctcagcgccaacgccaggcttttcgccctccgtttcctgtccaccagttaccggaacgcccccctgggtctgtttttgctgaccctgctggggctcaccctctggctggtgcgcaagccggtgcgggtgctggcacggaccggagaggtgttctacctggccctggccatcggcctgggcttctccctcctcctgggcgtactccaggtggagccccggcacatccttcccctgtggacggaggatcttccgggggtgctctccgccgccgttccggtgctgggcctgttcggttatgtggtctttgccgccttcctgggggggaatgtcacccggggagagggagaccgccgccgtgcgctatggtgggcggccgccttctgtctggcgcttaccgcccttcagcttgtctgcctgggcaacttcgggcccgggctgaccgcccgcatggacacacccttttttatgatggtaaaggggatcggcattgagggcaccttccaacgggtggagtcggtcatcatcgccctctgggtgttctctgatctagccctgctcaacctgctggcgggctcctgctccgtcctggcccagtccgtattctctttaaaggagcgcaagcacgccgtacctcctctgctcctgctggccctggcgggggcctggttcctctttcccgacgccttttccctggagcggtggatggagggcccggccaggattggcagcctgctcttcggcttcgtcattcctgttttgctcctgctggtaaaaaagctgcgcaggcaggtataagggtggcagatcttgtgcatgctatggattagaataccagtgatccggtccggtttgacagccgagaaaaaaacctgaaaaaaagagaaaaaggtgttgacaaagaggaggaaagctggtattctaactgagcgcctcacggagggcatgaaaaaacaggaaagcggacggaagagaccgggcggaagccggacggactttcggaagcgggctgaaaaaagtgcttgacaagtgagtgagagcgtggtaaactaaatgagttcgcgccgagaggcgggaacttgcttgaaaagaacaaaaagaacggccatgaggctgaaaaacctcaagaaagtttgaaaaaagttcttgacaagcgaaagcgtgagtgctaaaataaatagcacgtcagcagaaaagctgacaggggcgtgtaccttgtaaattaaacaacgtgagagaaacacgaagcaccagaaaggacgagaagtccttctgagcaagcgcaagcttgatgaagaaggctcttgaatagatttctttgaagctatgaattaagcttcgataagatgatttgaggaacggagacgttctttggataccattttattgagagtttgatcctggctcaggatgaacgctggcggcgtgcttaacacatgcaagtcgaacggggtgctcatgacggaggattcgtccaacggattgagttacctagtggcggacgggtgagtaacgcgtgaggaacctgccttggagaggggaataacactccgaaaggagtgctaataccgcatgatgcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccactaacgaagcagagatgcattaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaaggtgcggctggatcacctcctttctaaggagacttcaacggaagtagttttctgttgtaacgtcctaaggtcagctttctggagcgaatggctttcacgttgtttaatttagagggtacacgcgtcaagaacatatgccggtggcatatgtttagcgtgtaccgcggcggctgtgccgacgcgggccaggcgaaagagaagcgaatggcaccttgaacgggcccatagctcagctggctagagcgcacgactgataatcgtgaggtcggtggttcgagtccacttgggcccaccaccaaaaccctgggggtttagttcagctggtagaacacctgctttgcaagcagggggtcaccggttcgagtccggtaacctccaccaatttaagaatggattttaacactcaagggattgagtgttaaaatctggccttaaaggctggaaggcggcaccttgaaaactgaacaatgtagatcgaaagtacaagagcaagcaacagagggcaaaacagcaatgttgtggaactaagatagaatggcgaaagccgttctagtaagggtaaaaacaatggagctaattgcaaaacttctgtgatgcctgcataattcatgattttgagaacagctcagagatgagactgttctacaaggtcaagctagaaagagcgcaaggggaatgccttggcatcaggagccgacgaaggacgtgacaagctgcgataagctgcggtgagctgcacataagctttgacccgcagatttccgaatggggaaacccggcagagcaatactctgtcagcgtgcgttgaatcaaataggcgtacgcggggaaccgcctgaactgaaacatctaagtagggcgaggaagagaaatcaaccgagattccgctagtagtggcgagcgaacgcggaagagggcaaaccggaggatttatcctccggggttgtggacagttttttagcaactggaactaggagaacggtatgggaaggccggccatagcgggtgatagccccgtatccgaaagggaaggttgtgcgactggatccagagtaccgccggacacgtgaaacccggtgggaagctggggggaccaccctccaaccctaaatactacctgatgaccgatagaggagcagtaccgtgagggaaaggtgaaaaggaccccgggaggggagtgaaagagaacctgaaaccttgtgcttacaagcactcaaagcccgttaaagggtgatgaggtaccttttgtagaatggtccggcgagttattgttactggcaagcttaaggcattcagtgccggaggcgcagggagaccgagtctgaatagggcgtatgaagtcagtggcaatagacccgaaaccgggtgacctatccatgggcaggttgaagtgggggtaaaaccccatggaggaccgaacgcacgcccgttgcaatggtcggcgatgacctgtggatagcggtgaaattccaatcgaactcggagatagctggttctccccgaaatagctttagggctagcgttggcttagattaccggaggtaaagcactgaatgggctaggggccgataaggttactgaaccctatcaaactctgaatgccggataattgatggccagcagtcagtctacgtgagataagtctcgtggacaaaagggaaacagcccagacccacagctaaggtcccaaagatacgctaagtggaaaacgatgtggagttgcgaaaacaaccaggatgttggcttagaagcagccactcattaaaagagtgcgtaatagctcactggtcgagtgactctgcgcggaaaatataacggggctaagcgtaacaccgaagcttgggctgcacagcaatgtgcggggtaggggagcgtcgaatatggggtgaagtcgcagcggaagcagcggtggactgtattcgagtgagaatgccggaatgagtagcgagaattatgtgggaatcataatggccgaaaatctaaggtttcctggggaaggttcgtccgcccagggtaagccgggagctaaggcgaggccgaaaggcgtagtcgatgcacatacggttgaaattccgtagccaccgaaccttaagtacactgacacatggagatagcgggacccgggcgttggttgacccgggcgtaagggaccgaactttagtagggaagtccgcgatgctctgtggcgagaaaaggtgtatggtatgctaaggtgcccgtaccgcaaaccgacacaggtagatgaggagagaatcctaaggccaacgggagaagggttgttaaggaactcggcaaaatgaccccgtaacttcgggataaggggagcctcctacgggaggccgcagcgaataggcccaagcgactgtttaccaaaaacacaggtctctgctaaatcgaaagatgacgtataggggctgacgcctgcccggtgctggaaggttaagaggagatgttagccgcaaggcgaagcattgaatcgaagccccagtaaacggcggccgtaactataacggtcctaaggtagcgaaattccttgtcaggtaagttctgacccgcacgaatggcgtaacgacttgggcgctgtctcaacagcccacccggcgaaattgttgtactggtgaagaagccagttacccgcaactagacggaaagaccccatggagctttactgtagcttaatactggaaatcggtaaatcatgtacaggataggtgggagacttggaagccagggcgtcagctttggtggagtcacccttgggataccacccttgatttgctggttttctaacctgcggccgtgaatccggtcgggggacactgttaggtgggcagtttgactggggcggtcgcctcctaaaaggtaacggaggcgctcaaaggttcgttcagcacggacggaaaccgtgcagtgagtgtaaacgcataaacgagcctaactgcgagaccgacgggtcgagcagtaacgaaagttggagttagtgatccggcggtatgcaagtggaagtgccgtcgctcaacggataaaagctaccctggggataacaggctgatctcccccaagcgtccacagcgacggggaggtttggcacctcgatgtcggctcgtcacatcctggggctgtattcggtcccaagggttcggctgttcgccgattaaagtggcacgcgagctgggttcagaacgtcgtgagacagttcggtccctatctgttgcgggcgtaagagatttgaagggagctgtccttagtacgagaggaccgggatggacgtacctctggtgcaccagttgtcctgccaagggcatagctgggtagctatgtacggacgagataaacgctgaaggcatctaagcgtgaaactccccctaagattagatctctcattcgaaagaagtaaggcacgacgtagactatgtcgttgataggccggaggtggaagcacggtaacgtgtgcagctgaccggtactaataagccgagggcttgaccttaacatggatgattgcaggcgcttgcgaagtgcggaagatttacattgttcggttttgagggtgcagcaccctggatggtggcgacaagcgcctttagctcagctggtagagcaactgactcttaatcagtgggtccccggttcgaatccgtgaaggcgcaccaatggcccgttggtcaagcggctaagacggcggcctctcacgccgcaaacgtgggttcgattcccgcacgggtcaccatcatttttctcttgacaaagaggaagaaaatgaatataatgacttatcgttgagaagaacggtaaggagaagaaagttgttagagtttcttttgcttacttttcttttcgaaggaaagtaagttggtgttgattgcggtgagggtccacccgttcccatcccgaacacggaagttaagctcacctgcgccgaaaatacttgtctggagacggaccgggaagataggtaacgccgacacaaaagaagggtctggcctgaccaggccggatcctttcatattcctccttagctcagtcggtagagcatgcggctgttaaccgcagggtcgttggttcgagtccaacagggggagccagaatgtggcttgccgccacagttgctgtgacggcaagcctactttttaaacgctgtggaacggtatgggcctttagctcagttggttagagcagccggctcataaccggccggtccacggttcgagcccgtgaaggcccaccatttaggggtatagctcagctggtagagcatcggtctccaaaaccgagtgccgagggttcgaatccttctgcccctgccatgacaaattacagcgaccgctgtcttttgatagaaagatggcgcggtagttcagttggttagaacgccggcctgtcacgccggaggtcgagggttcaagtcccttccgcgtcgccatttgctgctgtagctcagtaggtagagcacatccttggtaaggatgaggtccccagttcaaatctgggtagcagctccaaaaagccttgaaaacttcggttttcaaggcttttttgttgcgaattttgattttttggtgtgggtcaaaatgtgggtcagttggttgacccacaccgtgacccacatgcggaaagggccggaaagggtcaaagtgtgccgggcaggaagtttgcacttcctgcctgtctttttctctgccttacatgacttgttccataaagctgcccatggtggcggctgcctcgtcctgcttctgcctggtggcgtgagtgtaggtgcggagggtgaacccggcatcgtagtgccccagcatggaggacaccgtctttacgtccacaccgttctggagggctgtggtggcgaaagtgtgccgcaggtcatggaagcggatgtgggggagcccagcgtccttcaggagcttcttgtggaggtttaccaccgaatccgggtggtacatttccccggtgataggggaggggaacaggtaggggctgtccgggtgcttgtcgtgctcctggatcagcaggtcaatcgccgtctgcggaatagatactagccgcacggagttttccgtcttgggccgggtgagctccaaggagccgtctgggtttcggacatactgcttgctgacggagattgttttgccctggatgtctacgtcgtcccaccgcagggccaccagctctcccttccgcaggccgctgaccaattccagatagaacatggggagcagatttcgggttttggcggcttccagataggcgtgcatatcttcagaggggagaatctgcatctcgatctttcggggcttgggtgcaatgcagtcctcggtaggattcctgggtatcagccgctccttgaccgcccgttccagcgccgcatggagcatcaggtggacactgtgaaccgttgtggtgctcagtcccttgacctgtgcctttccaatatgtattctgccctcctccaataactctttatagagcttttgcaagtgcctggtggtcagtttctttagcttgacgttaccgatgcgagggatggtgtaggtctcaataatgagctcgtagcggtttgctgtggcggtacgcacatttggcttggcgtagagctcataccaggtgcgcagccaggtagccacagtgtactcgtctgccgccttactgacgtccagaccttggcactcctccaaagcttttttcagcttttccttgacctctccctgggtcttacccagcacattcttgatgatccgttttccggtcttgggatcgtacccagccgtgtaccgtccttcccagcggccatccttccgtttcctgatgttgccctctccattagctcgtttttttgccatggggtgccacctccagctcttttgcaatttcctgggccagcttgaacccggcgataaagcttgccagagagattttctcccgcagcaggttttgcgcatccaccagctgcatcagctttcgccgttccggctgcccaaggtagtcccgcacttcctggcgggtctgctcaatttcctcctccaattcagtgaagtccggcacctggaaaaaccatttatacagggcagccatgtagtgatacattgcgtgtcgcctcctttgcagcaacacacaataccagctttcccgatggatagccatagggaatgggcagagttatcagaacagtaacaattactttttggtgtgcagcccttattctttgagtagcgatgtaatttttaatacgcttagggctccgcacttgagtgtgcagagccccagcgtcacatcatctgctgcccctgatcgtggtcatccggcttatgtcccagcgcgatctttttttgctgctccctggccagagcctttcggtctccgtggccatgtctgatggtggcatccaggacaaagtcatcgggatctccctccagcctggacagcaggtggagcacttcggttgttatgtcagcgtttgccacatgagaatacacaccggcaccgccgccgctgccgaactcatgatgatgaaggggatccatctccggagcgaagagatcgcctcctgggtgtccttctgaaaggccgacccgatggctgagagctctttggtaaattcgtctctctgcctcccatcctgtctgattgtttctttcatgtctgagagtatgtgctccattgaccggtaggtttcctggttgaaggcctgcgtctgctccagccactgctggagcagttctgaggtggccagcggctccaggctctccttcgtggccagagtggccatggatgcctggatcgttttctggagggccagggtatgctggaggacattctccagctgctccaccgtctgcaccggcatcgtatacagcacattggcctgttgttccgtcagggtgggaggtgccgcccgctgcttgagggctgccaaagcactgttgtgctgcttgggctcgtattccaaactcatgctccatgttctcctttctgaattttagctcgtgcagtctgtcgtctctgcacttcattccggtaggtgtggtgtaggtgatgcacttccgatattcctcccagcgtacctggtagccctgtcttttcatttcctgtacaaattcttctcggctgccggctactttcatgactgcctccaccgtggtgatgagctggaacttccagctctctccccgcatagccgcccggtattccccggccctcagcccctttgtccggtgatcctgccggtacggctttagagtggtcaagccgtgctccatacagatctgatcactaaccttccgcatctcttccagcgttctgggagtgaagtggagcttctttccggtatccggatgaaccgagttgaccaccagatgggagtgggagtggaggtgctgcctgtccacatgcgtggccaccaggacctcacagccgggaaagaactgctctgccaatttcagcccgatctgatgggcctgagctggtgtaaggtcttcttccggggagaaggattggatgtactggtagaagaaggtgccggtgtctttcccatagaggtgtttggtagccatgaagctctgcatggccacatctgccacacagttgacgcccgtcaggtagcggttgccctcctcgtccatggttttctttggctgggatacatactggattacccgccccatgctccctgccgtctgcttgcgttccttgatgaagctacaggttgccatggtagatcaccgggcctttctccgccagtgtgctgactgcctcataggttctgcccagggctgcggtcagctcctgtaagtaggcagtctgcactctcccctgatgggccaaggtagtcagctgatttaggtttttaccccaggcgcgcagctccgacagaatgggcttaagttcctccatcacatagatgggctgattcagtgcggcatccagcagatactcctgttggctcaggccggagcgtctgaccctggcgctgatttgcctcctctcggctggggttacccggaaggccaccacctgattcctggttcgcgttgccatgcttcctcacctccgcataaaaatttggtatgctgccgcttcctatcgggaacgacaacataccaaaaatttttgtggatagccataccaaaaggtcagagttaagagaaagttatcaattacagaaatcccgttccgcccttatattgttttctgcggcgcaagctttgaggtgtggagatgaggcgccgctgccggtcagcggaaagtgggtgcgggcttctgcccgcaaacatgcgtttggcagccgcttgcggcaagccaaatgctctgcttgccccacccaagggtgggtaaaatcgtcccgcgctactactggctttctatctaggatcaggagaatatccgtactacggggaggtgtgatgtgcgttctcctctctaggtttggcagcgggctaaattcgtctcaaaaacattggtagggcagctaccctacccagccattcaaagagccgcatagtggtccacaggggcaaccagcggggagatttgtcgcccgggctcttaccgggaggagtgtgtgcgggaactgaatgaactgtgagaaagcaggaagcctgccccggccgggacaggcttccttttcagtgggggtttcattttgttatttttaagttgttgatacacttccccagcaaggagtaaaggaggtggacacagcctgggccttgtaaagcgtacccttgctatgggggacggagcggtagtttatcccggccatctactggcccacacccacttgcttagaggcataatcacaggcttggctgaacgatttaattagaaccttaggcaaacactacgggctacagggtggtgtgcagaaagccgtgctcacgctccggtgggcgggggcattcaagcggattggctaagtgtggccatgggtgtcagccacttcatggaacggacagatggtgtaaatcaggtgcacgtttatggggcacccattttacacgcacagtggtgggcgcctacgtgatgagccccactcttccagtatcgcatatattacgtactgtgttctcgcttatgcctccggtccgcccgataccttggatgctgggctggtatggatgggcttccgatttttcagatacttcagatagtagtagagcgccagttcacaatgaaccagcctcaacaaaaaattcaagtaggaagcatgaaaaatgcgtgcgtcttatgcttgggttatccgtggaagcgcaatgtttactagactcttttcctaatgaaacgggcactctgtcgccgctgttacagatgcctctttattgcccccgcagcttttctgggacagcaacctatcgctgaacccttccggagccgtcgccgctggccagcttttccacctcattgcacgtaacgcggttgaagtccccctctacagaatgcttgagggcagaggccgccacggcaaattcaatggtatcttgggccgactttccgctgagcagggcgtaaatcagtccgccggcgaagctgtccccgccgcctacccggtccacaatatgcagatgatattcctttgaaacatggcactccgtgccatcatacagcatgcctgcccagttgttgtcgctggcagagagggaggtgcgcagcgtgatggccaccttttcaaacccgaactgcccggccagctgccgggcaacgctttcatagcccgacttgtttagcttgccgccataaatgtcgctgtccgcagcctcaatgctaaagatgtccttggcgtcctcctcattggcgatgcatacatccacataccggcatagctctgtcatggcggccctggcctgtgccctgctccacagcttgccccggtaatttaaatcgcaggagattttaattccttttgccttggccgcctggcaggcctggagacagatttccaccagatttcctcccaacgcgggtgtaatgccggtaaagtgaaaccaaaccgcgtcctcaaaaatgctgtcccagtcaaaatcctccgcctttgcctgctgaatggcagagtaggcccggtcatagatgcacacgctgccccgctgggaggcgcccttttccaggtagtagatacccacccggtctcctccgcggacaatatgggaggtgtccacccccagcgcccgcagggcgtttaccgccccctgtccgattgcgtggctgggcagcctggtcacaaaggctgcgcgcatgccgtagtttgccagagataccgccacattggcttcgccgccgccaaacgtggcctgaagctggtcatcttgaaaaaagcggttgtatccgtttggcgccaggcgcagcattatttctccgaaggtaacgatttttttcatataaaaagctcctttccaaagtccctttacttccgcatcagatgaacggcaaagccggcgaacgtctgattcagataaatcgccttggtgcgccctttgtcgtccaccttgcgtgtgtgctctaaaaattccgtgccctgcaggcctagatggaattccgcccgctccacatccggcgtcccaattgcgatgtgcccgtgggtgccgggcagctccgccttgcagcactccacaaatggcacggcaaaatccgatgtattgccctgccggtactccagaccgaaaagccggcagatggcccgtgccgtgctggccgcggcgtccgcgctgccgcagggtaggcccacatgttgaagggtaaaattcagcatggttcccacagcctgccggcacagggcggtaatcttatcccactgctccccctcaatgagctcgctttttgccatccaggagccgccgcagaggcggacgcggtcataccccaggtattccgaaaagttttttatgctgatgccgccggtgggcataaagctaaggcggggaaagacaggggccagggctttaagagcaggcaggccacccgcctgctcagcagggaaaaatttgaccatttccaggccggcagttaccgctctgcccaggtcggaggcgtttgcacacccgggaattaccggtacacccagacccaggcagtaggatacaagatcttcgtcgtacccgggagagacaatgaacttggcgccggcggacaatgcccgctggcattgccccacattcagaattgtgccagcccccaccaatacctgcgggcaattctctgcaatcaggcggatggcctcttcacccgcctgggtgcggaatgtgacttccgccgccgggatcccgcctgctgccagcgcattggccagcccaaccgctttccccgcatcttccacagagacgacgggcacaattccaatccggcaaagctgctgcaaaattttgttcatgaaaatacctcctttacaaaccggcaggttaaattgacaattagattataatacttgtatactaaaaaacaagatgagcgagcgtaaaaatttccccgccgttttttgtgcaaagcggagaattggataaaaatactggttcttgacgggcgcccatagtttttgtatgctagtagatggaagaaatacaggaggcgagaggtttgtatttgacagagcgtctcccccgggagacgggccgcgactacgcgctgcgcatgctgaaggacaacattgtccgccttgagctgaagccaggcagcttggtcagtgaaaacgagctggccgcagagatggggctctcccgcacaccggtgcgggaggcgttgattgagctgtccaaggtaaagattgtggaaatctatccccagcgggggagcgccattgcccgcattgattgccacatggtggaagaggccaagtttatgcgcagggtgctggagtgcgcggtaattgagctggattgtgcgctggcggacgcaaaggccatcaatatgctccaggaaaatgtccgtttgcagcagttttatctggaaaattattatgcggaaacacttaccgatttggacaatcaattccaccgcctgctgtttgaaatcgcgcagaagccccaggtatataccttaatggacacaatctccatacactttgaccgggtgcgcagcatggcgctgaccacagtgaaaaacacaaaaatcgtccaagatcaccaggctctgatgacggctgtggcacaaaaggatgccgttagggccagggcgctgatggaagcgcatcttgaccgctatcagattgacgtggaaaagattcaggctcagcatcccgactattttatttgaagagcaaattttaccgcgtgtcctgctgtatgcagtgtgcgaaagcatccccggtccatgcggagtaacagctccgcgtggaccggggatgcttttctaattggattgtccttctataatcagacaggtgagatacagggaaataaactcctgctcgttcagggcggagaactccatgccgatgagccgcgacagcttctccagtcttgtcttgagggtgttcctgtgaatctgcaaaaggtcagaggcccgggaaaagtttccccctgctgccagaaataccctcaggtcatggatggttgccatcaggcgcttctcctttttctgcgccaactgcagcaggctgaaattgcacaggctctcagggacggtgctgcggttgaggatgctgcacaggcattggcaatattgctcttgaaaaaagtagagtccgcccgcctcggcaggggctggccgcaggtccagcgccattttgcactggtggtaggcccaccggacaaaggagacatcgtgaaagcagctgctgacacctgccaccagtccgttgctgcgcagtaccttgcgtattttggagagtttggccgtagcgtcaagggtgtccggttccacaaaaataagctcgctgttgtggataaacgcagtgggagctgtcagaatcgcatacaagggggagagcacatcatttaaaaacaccttggaatagcgttcccgctcaaagggaatcaccaaaagggagaactgctttttcccgttccagcgctccggcagcaggcccataataggctcaatcgggtcctccgactcgctgctgatgtcaatgattccatgggcactggcggcatccagcgattcaaagtcggaaaacttgtcaaaaatcgattcaatgcgttgctggagatagtacatcagagagagctgacccttggagaaggtgctgtaccccataaagaccatggtgcaaagcaaggtgcttttgttgtaaagcggaacaattacatcaatattttcctgctgccggccggatacccaaagcgtaaatgggtcatgccggctgttcagatttgaattcagaaatcgccgctcctccgggctcagcatgtcatggggaaatatccccttgtaccgcagggaatcccacacgctgtccaaagagctggcggagagttcaccggcagagaacacaaatcgcccaatgcagttgataagcgcaatcggcacgcgaaagaccgaggaggcaatgtccagaaaggccttaaaagagtagccggacaaagccgcttccgacagcttttcctcccacttgcggtaggccttgaatgtattttggacaatgtcaaatacctcgttgtaattagcgctttccaaaataataattgctgaccagcctttgtccgtcagaagcgacggatccacattgccctggcacagaaaggtcagcgagcgcttgtccgtctgataataggcggagataagttcctgcgcggtaacggcatacatatactccgtgctccagcgctcttccttgttgggcagatagcggattccctccagattcagctctgggctgtcagaagccagtatgaggggattgaattcagatagcgcatcgtgcaggatatgcagattcattctcatgtgacacaccccaatcgcggattgcagcaaaaatgatgaattatagcaactttaaagtataatatttttgcggaaaagtcaacccaggaaaaggaggagaaaaacatagacaaatatgcacaaaaacgagccggcaagcaggcattgggatgacttgaatctgtgcaaaaacgatgtaaaatgacagtaacggggataaatgagacatatgtggcagaaaacgacgaatatttgtattttaaggaggaaacgagacatgaaaaagagactgactgctattacccttgcgcttgcaatgacacttggcttgactgcatgcggaaatacttctggtcaaaatcagcaacccgccggagagtccgggcagccggcctcggacgaacctattgtcctccgttttgctgatacagacagtgcagattctgtggctggtcagggcggtcagatgttctgtgatctggtggaggagcgcacggatggccgtgtggttgtggagtattatccggccagccagttgggcggcgataaggcgattaccgaggctgccattgcgggcacggttgatattgctaagtgttccaacggaaattttgtgcagttttccgatgctcttgaatgggtagacctgcccggtgtgcttagttctgtggagcaggtacgtaaactgttcaccagtgaataccgggatgaggtaaatgcgcagatcctggaagataccggagggattgcgctgatgttcgatgtggatgcaggggaaccccgtgcaattggttccaccaagaaagaaatccgtgtcccggctgatatgaatggtgtaaaggttcgttctaccggttcggaaattgagctggcgctgtttaacaactggggagcgtcctctacctctctggactggggcgaagtctataccgcaatgcagcagaatcttgttgagacaacctataatcaggtgcagactctggaaattaatagctttggtgaaattttgaactatattactcccattaatcagtcctgggtggtttctgccaaatttattgggccgaaggctattgaaaagctgggtggtttggacagtgagctgttccagattgtacaggaatgtgcactcgaatgcgaagtgtggaaggacaaggcttttgttgaggctaacgcggagtcctatgaaaagctgaaagagcagggagttaccatcgtggagctgactgacgaggagatggcgctttggaccgaggcgtccgaggccatttgggacgagtttgtcggtgagggcaagcccatctcttatgattttattgaatacgtgcagagctttgcctaaacaagcggcaccctttccaaaggagcgattatatgacaaggataacggtgtggattgactggatcagcactttgtgcgctaagatgggaaaggtcattgttttggtaggcggcacgggtattctgctgagcatggctatcggcgttttttcccgggcgctgctgccgcaggcttttgtgtggccggaggaggtaagccgctatctgctgatctggtgcacatttatcggcggaagtgtggcactgcataacaaaaacctggtccgatttgagtttatcatcaacctgttcaaaggaaaggcgtatactgtggcggaaattgtgggccacttgctgtctctggtgtttttggtgctgtttacccggattggcattgacctgattccctattacctgaactctgtggggacaacggtccccatccagttaatttggccggctgctggtgtgctgctgggcggcgtgtttatggtgattcacatgatcagccaggtttgccacgacatcctcagattgaccggccgggaaggaaaggaggcaaagtagtagcatgaatatgggtgtttatttgttcctgctgctgtttgcgctgatgttttccggtatgcccattgctttgggtgtgggcatggctgcgatcctgaccactggaatctgggggcaaattgggcttgagctgatttttcagcagtactaccagggcgtaaacagctttgctctgctggcggtcccgctgtttatgcttgcaggggaactgatgaccaggctgggcctggtggatgacattatcctcctggccaaactgctggtaggccggatgcgggggtcgctggcgcagatcaacattgtggcctcggtgttttttgccacaatgtccggctctgcggttgccgatactgccgctatcggcggtatgcttttgccggccatggaaaaagaggggtatgacaaggagttttctgtggcggtaacagccgcttcctccattatcggaccaattatccctcccagcattacaatgattgtctatggttcgctcatgtcaaacgttcctacgggcgcaatgtttgccgccggtattgtaccaggcgttttgatcgggttgggcgaaatggcgttggtttattatttcagcagaaagcgcaattacccgagagaaaccaagcgatatacggcaaaagaggcgtccgctattgcagtacgtacccttcctgcggttctcacaccggttgtcattgtagtggccattttctccggcttctgctcggccacggaggcggcgtgtattgcaaatatctgggtgcttattactggtgcgctgtattacagacggctgaaccttaaagtgtttggggagagtgttattgtagccgtggagaccgcaggggctattctgctcctcaatgcagcggccaagcccctaagctacctgattgccatggcacagctgcccaccatgataagcgaggcgtttaccagctttaccagcagcaagatcgtcattttgctgctgatcaatgtggtgctgctgttcttggggtgctttatggaatgtaccgcaaacgtcctcatttttgcccccatctttgcacctctggccatctcctttggggtagatccgctgcagtttgccttgcttttcgtggtcaatgtggtctgcggcatctgcacacccccctttggtcccacgattttcctggctgctggtattgcaaaggcaccgctggaacgatgtatgaaggcgattataccgttctgtgtggtgcagatagccgttatcctgatgatttcctatattccggctctgacactgacgctgccgcggctgctgggcctgtattagtctatgggtacggcggaggaagctatctgccggtttgtatcggcacttcaatggcaggatattcccgaagctgtaaaaggctgtgcacgccgctgttttacggataccatggcctgcatcatttccggcggaaaaagcgtccagttccgggcggcggaagctgtcatcgatcagaaccatgcttcccgccactatctggcggggcaggggctggagcaggtcaacttgtacgacagcgtgctgctcaacgcctgcgctgcccattctgaggagtacaatgacttgttttttgggcggccgggccatcccagcgcggtcctggttccggtggtacttggcctgggctttagccaaaatgcctctgccaattctgtaatggagagttatgtggcaggcctggaagtaatggcgctggtaaaccaggcgcttctgcccaatgctcataaaatgggcttccacaccacttcggtggcaggggttgtcggagcagcagcggcggccggcaaactcctgcatctgccgcaggatgggctggaacgggcgctttccatagcctgcacgtttgcttgcggcctgcgggcaaattttggaacgctggccaacgcgctgcatgtgggaaatgccgccgctgctggattgcgtgccgcacaatttgccgctgccgggttttatacaggaacggatttgttatccggcagcttcctgacatgctatggcgggtcccgtgagcagctggagatacttgccggcagcttggggcagacatgggcgtttctggagcctggtctgctgattaaaaaatacccctgctgtttctccaattaccaggccatagaggcggcgctgaatattaccgagatgccgggcttctcctatgacagaatagagcaggttacttgcctgacctcagaaaaccactttatgtcactgccggtattttggcctgatactccatatagagcgcggttttgcatcccttactgtgttgcggccgctctgctccaggggaatatagatgaggccagctttagcgaaaaaatgctgcataatacggcgctgctgcgctgccgagaccggattcgatatgatgtggaccccagacagcggggagaggagggctttgggtattcccgcatcattgtggtgcaggactctgggcagagatttgaggctgtgtcctggcccagggaggaagaacgggctcaatgctgggacgaaaaatttttgaaaaataagttcctgaactgctgcgcctggacattttctaagacacaggcacagcgagtgtatgatgtatgcatgcatatagatgagctcagagagatctctgagctgctctgtgtactgtgtagaaacgaaatgcctgaaagcgggtgaagaaagtgaaattaattgatctatccaccgtgatatctccgggtatgccaaagccaaagtcggcgccgcccgtgctgctgcgctatatcctcgaaccgtcggaggaacaggaaaaggcgcagggctttaccaacaagatggaggagtataccattacaacccacgtagccacccacatcgacgcaccggcccacttctccgctcacggaaaaaacattgatgaatatgatgtgagcgagtttttcctggtacccacccagatgctgaacatccgccggggtaaatttgaagccatcacagccgacgacctgcgcgctgcggaggaacgggacggagcaatacaagacggagatctggttctcataaataccgggtgtcatcaatactactatgatgaagcatacaactgcgctccttatctgacaaaggaagcggcagagtacctggcagaaaagcaaatcaaaatggtaggcacggactccttcacggtggatgatcctcgggagaaggacaagccggctcatgttgtgttgctgaatcagcatggaatcctcattattgaatgcgttatgaatctggatgcaataccctgcacccgctttcagacggtctgcttgccgctgaaaatccggcaaggctccggggccttcacccggatgattgcagtctgtgaatagccggtagacggaacaggaaggtgcggacataagatgaacgaagcatatatggaaaaactcttcagcctggatggaaaaacagcagtggtaacaggctccagctccggaatcgggcaggcaatcgcggaagctttggcaaacttcggggcccatgtagcagtaatgggtaggtcacagcagggaattgaggagacctgcacgcggattcgcagcagcggaggaagctgtcagggctacgtgatagacatcactgacgaagaggcacagaaccgcttttttgacgactttttggccgagcataagcatctggacatttttgtggccaatgcggggatcaatgtccgcggtgagcttccggaggtgaccgccaaggagatggaactgctgctggggacagactttatcggcacgattcatggcctgaaccgagctgcggacgctatgaagaagcagcacagcggaaacatggtgattattacatcggttaacgctctgagcccgctggccaatcaggcgctctattccgccatcaaaagcgccatggagagcgtcatgcgcagtctggcggtgaccatggcggagtatggtgtgcgggtcaacagctgcgcgcccgggtgtattcacagcgccctaaatcagcatattttcagtcaggaacagttccgcagggaaaaggagcgcggtatcccgctgggcaggatcggaaacccggaggacattggcgacgtggtagcctgcatggtaagcgatgcctatcgctttatgacgggcagcacaatcctggtggacgggggagaacttctccgccccaagatgaaacagccggcagtggactgcgcgaaaatctgaaaaaggaagggtattcccgatatgaacagatattttcggctgaatgacagtgataacgtggccgttgtgctgtttgacgcgcagccgggcgacaagctggattttgagggacttcacgtaacggtcacagaacccgtgccctacgggcacaaagtggcgttgtgtgatttccatacgggggatatcgtatacaaatacggctactcgattggcaggtgtacccgggacacgccgcagggtggatggatgcacgtccataatattgtcagttgcagaggagaagccggaaaatgaaaacattttatgcatatgcgcgggccaacggcagctatggaatccgtaatcatgtagcagtgatcagtgctatggacaacagtaatttcatcgcacggcgcgtggctgcctgcgtgacgggaacagtggaagtctgtccttgctttggacggggcgaggtgggcgcagatttggaacagcatattgcgactttgggcgggctgggtgcaaatcccaacgtctttgccgcagtggtggtaacgatggagccggtaattgccgggcgaattgcagatatcatccgcgactccgggaaggaagttgtggtctgttcatgcgatgagtgcggcgggacgattaacactacttgccgcgccgtgcggtacgcgaaggaatttgtcattaaggcctcggagcagaagcgggtggaggttcccatcagtgagctgatgctgggtgtggagtgtggcggttctgactccgtctcgggcctcattagtaaccccgccaccggcatggtggccgacaaagtggtggatgaaggcgggcgggtagttttgtccgaaaccacagagtggatgggcgcggaggaatccctccgcacccgcgccgtaacgcctgagcttggccagcgcattgtggatgccatcaagtggtatgaggattatattatcagcattggcgtggacatcaagggcacgaacccggcaccggacaatatcaagggcggattgtccactattgaggaaaaggccctgggcgcggtggaaaagggtggcaccaggcccattcaagatttgattacttataacgggaaggtctcccacagagggctgacgcttttggatgcctcccccggtggggtagaaaacaccacctctctgaccagcattggctgccaactcattattttttccacaggaaagggcaatcccatcggaaatcccatcacgcccaccattaaagtgacgggaaacgcccgcaccatggacagctatggcgacaacattgacgtggacatctccgccgtcatgacagagggtatggagctgagcgaggccggtgatttgctgtatgagcgcatgctggaatactgcaacggcaagctgaccacggcagaagtgctcggagataccgaggtagcagttacgcggctgggatataccgtgtaagagacagctgaagggaaagcgcgcaaaggagcaggcaggcttttgcgcgctcttttttggagaggaggaccatgatgagcagcataaccaggcagccttttggctttttgccggatggccgcaaggcacgtctgtttaccatcacccacaagagcggagctagcgccagcttctgcgactatggcgcacggctggtgggactgactgtcccggaccgtgctggagagctggcagatgtggtgtggggttacgaggatgtgtcaggctactgccgctgggaggggaatgcgggcgccgtatgcggacgggttgccgcccggctggagggcggggcctttactttaaacggagagacctggcagctgagtaggaatgaggggcagaacacccttcatggcggccaccacggctttgacacaaagctctggtccggaagcccggccggtgaggattccattttgttcagctacgtcagtcagaatggagaggaaggctttccaggcacgctggtggtcaatgtgatttgtagattttccgaggataaccggctaattctggattacagggcggtcaccgacaaagacaccctgtgcagcctgaccaatcacagctattttaacctggccggccatggcgccggcagtgttctggaccagctagtaaagattgaggcggattattactgcaccaacggcgcaatccccatggcagacggtggaattgccgcagtggaaggcacaccgatggattttcgcaccttttccccggtggggcgggcactccgctccgactttgtgcagcttcggcaggtcggcggatttaaccacacctatgtgctacggaaacgggagcggggagcgcttgagctggcggcctccatgtatgatccgggctccggcaggaaaatggaggtttataccactatgccgggcctgcacttttttagtgctaacaaaaccacacctcgaactggaaagtgcggtgccacatatgaccggcagtttggactgtgttttgagacacaatttttttccaattccgccaagtgcacgtggtttccctccccggttttgcggaaagaaaactcctaccgccaggtgacagaatttcgctttctggtctcgtaaggattagaaaactagatgacagcaatatagctggtaatgccaagtagttctagaccacgatgaactgcactggcagcattgccacgctctgaagcaatgctgtgcaaagaagctccatcctgagcctgctggtgtacaaaagagccgccctctcagtgcacgggtgttaagatggcggccgatgttttggctatcatttagacacatttagacagtattcctttctgcggagcattcataggaatgaatacatttgctcaagcagcatctgccagacttggcccaggtgcgttttgtacaagacaaaccaagtagcggtaggaatccagactaattcccttttttgcctcaattaggctgctatgcaccggagggggtgttggccaagagccagttcttacgggccataacaatgggttttatactgtgctcagtgcaattgttacttatctccagccttccatcctccggataaaataagtgataggaacaacaaacattggcatcaactagagaataagaccaatagtgtctgacccacacgctgacccacacggggaaacgagcgggcggaaacaatggacacaagagtgctagagagcatggatcaccggacggaaaagggcacaaaatgtcccgaaagcatgagacctcattctaccaatcagttggtaaggatgaggtctccggttcaaatccggatagcagctccataaagccacaccgatctggatattttaagaggaacgcttagagtatcagagggtgtggctttttttgtttcccctgaaattgccctgctccaaaaaagatattttcgaggggaaatggctgttatggcggtagtttcccagggtttttcgtatttgcccaacgtgccgcactttagtgccctatttgaaggccagccagggcgctgaagggataaaaatgatatacaaaaaacagtgcgccggtttgtttgatatgctctctccatgttgacagtgttttatttcactgtccttcatagaggaagcatatcaatcaggccgacgcctttttgttgcccagtaaattgaaaaagggcgtttttcaactttaccaataatccattggccacacagccagcgaggtgttgctgctgcccaaaagggcacacactttttcgtctgatatgctgaatagatttttcgcggaaaagatggcatgatggagtccccgagcgtgggactcaaaaggatgattaaaaggggcattttgcccgtagtgaaggagaacgcatatgaccaaagaaacctatttcgaggaactgtcctacgccctgcggcggcgggagctgctgccccggccgctggaggaggacggcctgctcccggtggagtggaacggccgcatcctgtgccgggtcacggagagcggcgtcgtccggtatgaccccacctgggtggacaccagcagggcaaaggccgccctggcccaggtcacggaggcggcggggacggtgatggagtacatgacgattctggagaatgccccacctctgaaggcggatggcctggcggacggttaccgggtgctggcagagttcaacggcacagtgctggccgggacagagacgttgctgggggcccagttcgtcacctgggcccgggactatgaccggagcggggtcaacaacggccactactacatggaggactatcagggcgccagggaggacttcgccctccgctccgggctggtggccagggaacgggtctttgaccgggagcagctggaggggctgcgccaggcggtgcagggcttcctctatggagagggccccgcctcctaccagcaggagttccaatgccggcgcctcctggatcagatcacagcccagctgccggaaagaacccaggatcagatgcagagcgaaagtcagaagcttggacagtccatatgagggcggtgccaaatcaggcgccgcttttttctatacagaaattgttggtatcgcttggtttgcggcatttttttcgttacgtatggtgatagctttatcccgccaaagcgggtattgttgtggtcagaagcccaccaaaaaataacgaggaggacacacgtatgaaacagattgagaagcatcccgcgccggagaagctgcttcagcagataactgaggaggcaatcaataccctggcgctgggcgggccggacaagatcggggatgaggctcccatggaggcaggcgtgaagctgattgccaaagcctggggagtgccccgggagagcctgcaggccagcctggagctgattgaaagagaacggcagcttctgcgcagcgggagcagcgaggacgctctgcccaacagcgaactgctgaagccttacgacggcaagatgattgccgaactgctctggggcctgtttgagacgacggccaggctggaggatgcccaagaccgggcggcgatgcacaagctggcccttctcatggcggaaagcctgaacctggatagttggatcgcagagtgcgggctatccaagccctaagacggaagcatacaggaggggctgtccttggacagcccctcgcccttgcgacagagaaggaccgtttacttccgctggagtggaaaggccgctctgacccagggcgaggctaactgccggcggcagcgcaatatctaatagaaagtagggagcaaatcttgaaccgtccatgtgagggcagcgccaaatcaggcgccgcctttttctatgcccagattttatttcatttctgcgcccacaagtcgtacgccccggagcacccggcggaaccgccgcccaggccggtatgcacccgctcccccctctgcgtgggctgcccctaccccgccaacggcttcttctgctggggaaaggacgggaagtgcctgcgctcggagatgcggcggctcaatgccccggacaggcaggtgacacaagaagtgaaagaggagtgatttcgcggtgaaaccaaatagcaactgcttttccctgcggccggccacccgtgaggaggccagcttattctactcagatgaccagacagacagatcattgggtacagtgggccatgtccggatggactttggctccagcggcaaggggttttaccatacctggtggcctcacaatggggaccggttcaacacgccggagttcaaggaggccctgcagcagtttgtggacgccgtgcgggaggatgggccgttgaaggatctgccctctatgggccaattctgccggcagaacggcggggccatcacggaggacggtcggagctatgggtatctggcggagatgggcgactaccgcttctgcctccggtgtacccccagccccggggaataccagtgctatctttactgctatgacctgcgccagcagacactggacaggccggtgggccgggtgtcctttgccaacggcgaacacatggagttcacagccccgcaggattacctccggaccatccgggaggagctgcccacaaaggatgggaccggcttccgctttgagaccctgacggatgacccggcggtgcgcaaggcggtggacgatatggtctatgacctgtatggggaggagaaccccagaccgctggcggattacattgcccgccatggccaggagatgggagggcagcagatgtgaccacacagaacagacagccggtgctgcgctgcgtcctgagcaacgtggcgcacccggagtatggccaggtgaccatccccttccccatccccgtcatggaatatgagcgcaccctggaacttctagccgctatggaactggtagcccgcctgaaacgggactgccgggtggacgagctggagagcggcttccccatcctcaaacgcctggagaaggtgggcgccaatctggacgagctggactacctggcccggcggctggacagctttgacgactatgaggccgcccagttccaggctatggcggtcaggctggatacgtttgatatgacggactttatcaatcttaccttctgctgccagcaggccacggtaattacaagcttctcagatctagaggagatcggaaaggcgcacatcctaacgctccatggtggccacatgcccgtggacgagttggaacaggtagacggcagggcggaggccctgaagttgatcctcaacgagcacggtaccgtaaccccctatgaggtggtctatgacaacggtatggagctggaacagctctacaaggagggcggccccttcccggactatcttgaccgggagttcgtcatactcctggaggcatcctccggcgaagggcagagcaccctgctggttctgccggacagcccggccaggctggaacggctcctgtgccgcaccggtatacgggacagcccccaggcacactccagggtagtggacagcaccctgcccggcgaggtcatccgcagcattccatcggaacatctgtccgtcaatggcctcaaccggctgtgccgggcggcggagcggattgcaccggaggatttgaagaccctggtacaactgctgaccgacaaaaatcagcctagccaggggccatccctgggcgggctatccatgtgaaccgagggggagagaatatgcagaaaacagaatttatccggcagctcaatgagctggttcccaggccgaaccctgtcaccaccgaggcgctgtaccgctttgaccgggagtgtgcggagacggagtacatcgatatgctcaccgccctgcgggtggtggcgcggaatttcagtgaggagacgctcctgggcgcctatgagatcatccagcaccaaaacgccgctctgcccagcgagctgttcgccgctgccgtctaccttcaggccgggcgcacaccggcagaggtgtccggcctggccagggagggccggcttatgggcttctttggcccggagcggccggaggagcccagccggattgcaacctgcaccattgtggagtccgggcaggagcagcggttttacaccatggacttcgggcgcttcaatccacagcatgccttgaagcgggccatcacatacggccgggaaacaggcatatccgccacccaggccatggcccgcctcaccatggatcaaccggagtttgccgaaaagcccggcgggccccgttgtatcctgaacggcttggactcggagctcactgaggcgctgttccagatctcgccggcctgccctgccgtggctgcccatatcacctgcaatgcagacctgggtatcacagagatagcttatcatcccctgtggctggagcgaagccagagtcaggcggccatccagcagatgtgaaaaaactgctggatatcacgggcacactgtggtatgttgtgtgcttaccagaagaaagggcgggaaagagctatgaaccatcagaggaaacagagcatgcgcaagaaccccgttgaaggccggcttccgctttggaagccggccttttctatccgaatgacacttgcggcaaaatgaagggaggcagatcattatgcaggatctatcaaaggagtggctggagttcctacggggccagttccccgcgggcagccggatccaaacatgggagctggatgatcccagaaacacgctggaggaggctggtactctggagcacatcgatgacgagggccggttccatgtccggcagagcgatggaggtgaacgtatcctgacccttggggaggagatgttctccgtccacccgcctgagtccacccagctcaagctgtacatgccaatgacggtcggcttttatgagccggatggctgggggaactgggacgagacagaacggctcctggacagccaggaagcggccggctatgcagatgcaattgccggggcgctccaccgggcagaactgccggaggaggaggcacgcggcctcatgcactactatgacagggaggatggcgtaaaccgcaaggtgctgtcctgccgttttaccgcggaggccagagacggcagactgtggggagtggcggaatgcctggtatcgggctctcttacagaggaggaattgaccacgctgaaggagatggctgccggacaggccagtgacggctttggagaggggtttgaacaacgccccattgatgcgggcggccgggagctgttcgcccacctgtggcagtgtgagaactgggagattcagacggagcaggagtggttcgggcagacgcaggcccaggaatcccacgataacggggcccctgccgaagcccagcgcagcgggttcggtggggagaggagttccggcgaaatgagtgagcattgcccgcagggcgaggcgaaggatatgaagcacggaacgacgatgacgatgggagggatgatacttgaataaggtatttacagtatccctgtgtaatccggacaaggatacttatgtgacactggagcttccggcggacccatatacggtcctggatgcctgggaacggctgcggctcgcaccggacaccagagtggaatgggagatggaggactatggggaattccccgtcctgttccctggcctgcaatctggcgagggcttccccgcgctcaatgccctggcggagcggctgaccagtctggacagccggcagcgcaccgcattcgaggggctggtcaagctgcaggacggcaggcccatggaaccagacgccctcattaccctgtctgagcaggtaaagcactgccaggtggtgcccgaggccacggatgacgcctcgttgggccgggtttacgcggcaaacggttccatccccgaggtgaaggatgtgccggacaaggtatttgaactgctggacttccagctcctgggccgccggatccgtcagtcggcgggcggggtcttcaccaggcaggggtatgtggtaccggatgggaactggaagcccacagagggccaggaaccccgcatcgcgccggaggccccgactggcttctttcggctggagctccggctcggggaggaacggacggagctcaccctccccgctggacaggagctggtggaggtgcgggagcggatggaggccgtgggcctccccaactgcgccgtcaccgccttccgcagccgggtaccccagcttccgacagcgtgggccacgccggagcggctggacaccctgaactgcctggccatccggctgatggtgctggcggagcgggactctctggccctgatcaagtacaaggcggtgctggaggtgtcgtccatttcgagcctggaggatgccatggcgttgacggaacagctggacgcctacaatctgaattgggccgccgcctccccggaggacgtggcccgtggggagctgcgccgctccatgggggaggagaatgccgccctgttatgcgggtacctgaacctctacggctacggcgaggcgctgatccggcagtacgggggcgatctgacagactacggtctgctgacccgggcggatggccagccggtgcagaaaccgctgccgccccagcccggactgaacagtatgggaatgaggtgcccctagtgtgaaagaaagagccggtcgagggcaaataaaaaagagcatacgaaaccagccctgtcaacatcaaagtatgcagggcaacgggaaggactgtggaagatggtcaggcagaatcaagaacggttagcccttgtgcttcaaggaatcgaaccgcctgcttcacggccttggcaagctgtttttccttcaagtgctcaggcatatcaaccttatacaggtcaacaggattccattcttctaagttggagagcatgacgtaaacagcagtcaaaatcattctggcaatggcaatgatggcccgtttcttgccccggcgtttggcaatacgttcatatttgagcgcgtagtagggggaagccttgtccttcacggctgcgtgggcgacttgcaccagcgcaggtttgagatatactcccgcacgtgaaatgcggacagattttttcttcccggcagattcgttattgcctggggtaagaccggcccaacagcacagacgcttagaagaaccaaattgcgtcatatcaataccaatttcagacaggatggtaattgcgctgctgcggtcaacgcctggtatcgtacaaagaagtatgatgtatccttcgtatctgttgaccatggtatcaatacaggtatctacccgctcaaccaaggagccaatgtagtgcaggtggtcccggacgattccaatacgagttttctgctcctgtgtgatttcatctccctcaattgattcgagaacatcatctgcttttttcttgagggagcgctgcaacaaagaaacgcaatgctgtgggtcaaaatcctcgtcggatgtgaggtagtccgtaatggcagctgcggacttgccaaacatatcggacacgacggaatccagcgccacattgcagacggtaaaagcgttctgaaagcggtttttctcgctgcttcgcatggatatcagtttatagcggtaacgagtcaactcacggaggatgcggatatccttgtccgggataaagctgcttttcaccaggccgatgcggaacaaatctccaatccatttggagcctttggtatcatccttgttgccttttacagctttgacccatttgggattggcgatgatgacccggacgcctcgcttctccaagatattaaaggcgggaatccaatacttcccagtggactctatacaaacatccatgcagtcgttctcatggagccagtcggcaaagcggttcaggtcagaattgaacattgaaaagcgtttcttctgatatatgggctgcaaactatcctgtggagtcttgatgatggttgccaccagaaaggatttgtgaatgtcaaccccgcagcaggttggaaatacgactttcaaactacatactccttttcgcaaaatagtgcggaggaagcagtgactgaaccaccaagctattaacaggtgttaatacaattcctagtgtgcgggctcgcagctccacttatttgtgcttgaaagatggttccagcactgattgatatactgttttaaactctggaagcagtctacgactcacctccccgtgcattgtagtatgcttcctcctcaagctaattttataagaaaggcgaccgtttgtctgcactctttcatctctatttgtgccgatagtgaaacggtcggcatggtgattgatatggacaaagcaggacttttacagctccccggcaggccggaggagcaggcatggctgcgggaacggctggaggcgctgaccgtgcgggagggaattgtcctggatataatcctccggaatccgcatgtgcgtgataccgcggtggcagtcaaactgctgagcaagctggacgaatatgaggtggtgggaggcatccgcagctacgaggatctggggctgtactatctggaggaacatgccgccagttatctggagctgcgggactacatcgacctggacaagctgggcaggcagtatgaggcacagcaccccggccggttcgcagggggctgctatgtggtatatccgcgaaagggggtgacgggcttctacgacggggtcaacctgcctgggccggactacagctggagcctgcggctgaagctggcctcatccgcggtgccggagggggtggctggcgctgccggactacaacgacatcatggacgtgaggccgggggagatccggctggccctggacgctctgggcgtgcagaccatccgggagtgcaccctgctggaggcacggtgcagcctgcctgggatcaccggcttggaggatgcatataggggacggctggaggatctcatctatgacggtcagaacctgggcttcatcctccaggaacagaaccaggggcagaaggggttcctccaggcctatctctggatactggagtatgagcactgcgccaccctgcccgctgccctggatttggcgcagaatctgaaccgctaccaggtggtgcgggcggatcagctccaagacatggcacggatggatctgcgcgtgcggttgggatgtgtggattgggccctgtcaggctgcattgatctggaacggtacggtctggatttgctgcggaagaagggctataccttgacagaggacggatgtgcatacatagctaggcaacagacgcaatcccaggcgccccaacagatgcagcagatgtaaccccagatcaaatctatatcaaaacgaaacaggggccgttttcccggaggggacagcggcctctgttttttgtgccctttttcgggaggacggcccggaaaaggaggacgtcatgaaagccaaagagaagcaactgctggagtacctgaagaagcactgccttggccagcagaatgccctgggcggggagaagctgatgaaggtattccgcatcagcggaacagagctgcgcaagctggtccataacctgcgggtagacggggcacccatctgcagcgaccgcaccggctacttctactctgccaacgcctgggaggtgattgccacaatcgggcatctccggcgaatgcgggacggcgtggagaaggccatccgcagcttggagagggccacgggggccttccgtctacccgggggaggtgggccggatcgctaaacccttctttccttgggtaggcgggaagctgttcctgctcccctacatcttccagctgctccccaggagggcgccccgtctgctggaggtctgcggcggcagcggcgcggtgaccctgggcttgggcgccgggtatgccccgctccgggtgtataacgacgtggatgtggatctggtcaacctgttccgctgtgcccgggaccggcccctggcgctgctcagggagctggacttcctgcccctccacgcccgggcggacttcgaggtggtgctccgcttcctcaaccacgagtatgaccccatggaccacatggaggacgagtttcaaaccgcagaggactacttcccgcccatggacaggcaggaggtgaagaagctcctggtgggccgggccaacctgccggacgtacagcgggctgcggcctattatctgagtattcggtacagctacagtgccaccggaaacagcttcggcgggcgcagcgtggagctgcgccgcttcctcggactgctccgacgcgcctcggacgccctgcagggtgtggtggtggagaacaaggactgctgcgacgtggtccggcagtacgcccggcccggcgcggtgatctacgcagacccgccctatctggaggcggagaggatgtacgccccctccttcgacctccgggaccacgtccggttccacgactgcctgtgcgccccggcggcgcgggacagccacatcgttctgtcctataacagccatccggacattctggccctcttcgccccggacttttacattgtgggctttgaccgccccaaccccatggcccggcaggaggacgccaggtaccacgagctgctcatgaccaactttgaccccggccccatgcttaaccgccagctctccctgctggataaccccggactggtatccagcgatcgtccagagctgcggatcttgtccgcccccaccgggcggctgccccgggtgtgggactggccgcaggactaagaatacgaggtgaaaacagaagatgaaatttaccctctgccatgacacaagcaagaagaccctggccatcccccgggccgccctccagctctccggactggaggacgcggagcggctgactctccgtgcaggacatggctgcgtggtgctcacccggcaggagggtgctgcaagggagcggctggagaccatccggctgctccacgatctgaacgtcggcatggttgtccgtctggcactggacagccgtccgtccagcggcatgccgtgcaaaagggcgtccgaggtattccgatcctatgacgcggagttcctggacatgctggagcactgcggcgtggatttgttcgggttgggcgccctgctggcccgggaggaggacgcccaatgaacctgcattactacaccatggacgacctgcggctgggccggagcggcttcctacagaaaggctggacggtccggcagcgcccggagctgggggaggccctggcgcactaccggggcatccccattaccaagcggaaggtgctgggcctgacggacggattccacgtgctggagctggtaaagaatgtgcccctcttcccggacgacccggagggggaggacgtgctggcttcggagctgggagagccgctgccccaatgggcgaacaccccagaggcccgccaagctgtccgcacctgtgtggaggccctgggtctccgctaccagatagagggcaagatcctggcacccatccccgtcaacaaaaagcagcgacgcaagaagctggcggggaaatacctctggcccgacgtccctggtaatcctgcctccgccctccggtgggtgtatctggccgggaagggctggctggcccccacggtgctcaaggaatctgccgccgtcctgcccttggtgctcaaggtgcgggcggacggcatcacggacaaaggcgactaccgccccctggagctggagccctgggagttccgcctcctggcccggcgcaccctggagcggctggagcagaatatgacaaaatgtgaagtctgcaaataaaaagtcaatagggaaatgaagaaaaattgagaggaggggaaaaggacatgccaaaagcagccagcaggtaaaggacgctggccggattagcaggtatgtagcagtaaggattatttctgaggcaggataatcgttgctttggagaaacctttccaatccaagcattgcccgcagcggtcacagtaaggctggtattcccgttcgagagttctcccacattgggggcaaactgggaaaccagtcaggccgtgaaagaagtgaaagcagcggatatgtgtaaccggcattggttcgcggaaggccatctctcgccagagttctgaggggatcaacaggtcatttggcgtcagatcaaaaccaacgcagagcttttccagcgtcaggatcgtaggcgcagtcttgccccgggcaatgtcagcgaagtatctggagctgaggtcgcatcgttccgaggcggcttcatagctgagtcttcgagtatcacataatttgaggacggaggtggataaattgtctaaaaacatcttaatcgctctctttctgtcataagatgtttttagcgtaaatgcagtatcgttccccaacaaggaaggatgcttccttaatttccctccaaggatgccagatattcttttactctgccatagtagatgcgcaggaacttgttggcgccggctgtcatgtaaaccagatagggtttgccctcggctcgtttcttgtccatgaaacggtacactggatcatcctggggctgtgttttcagtaggcagtccataaccaggaataaggcgcggcgcagctccggcgccccgcttttggaaaccctcgtacttttggcctcgtgagtgccggactggtcagcgccagggtcaacacccgcgaaagcggtaatggcgtttcggtgggtaaaccgggtcacatccccgagctccgccatgagctgagggccaagagaatcgcctacgccgtgcatggccatgacgacgggatattccgggagctgcgctgccagggcctgcatttcagccttgagccgttccatagaggcagagatagcgttcagcgcatcaatggcctgccggaccatggttttggtcagggcgtccctggggagcatggcgatcaggtcctgtgctccggcgtggacctcaacggctttgctctggctgaagttgtagccatgccgtttacaccacttgcggtaacgctcggcaaaggcagtgaggctcatgttccgcacacagtccacatgccaaaaggtcgtggcaaagtccacccacttctggctgccgtcctcacggacagggctgtcaaatagggcgttgacaccgggataggtctggtcaagaagggcgatgaggttatttttcatcatcgtcttagtcttggtgtatagactctgctgccggttcagtgttttcagttgcattcgaatcgtatccatgggtgtatgttggcgcaattctgcccagttgtcaataccgtaccgggcaatcttgcgggaatccgccttgtctgttttcactttgcgcagggtgttatttccgtagtccttgatgagcttcggattgactgcactgacgaagacgccctcatcatgaagaaagcgggctactggctcatagtaccgtccggtgtgctccatgactacccgtgtctcaccgtccaggcttttcaagtagtctgccagctccttgagttcgctgccggtgtgaccaatagaaaatggttttgctaccacttctccaaaaggacggaggacagacaccatgctctttcctttggaaacatcgatccctgcaacattgttcatattgatcgctcctcatcatggatttgttttggcgaccagccattccaccattgccgatccaatctatttgatgacacgggcgcaccaaggaggtggctcaacctgcataaatcgaacgctgcgaatgagaggctggctgacggacttcactacggacgctatggtccttggaggaacacatcaggccaagactctctcattctaacagctttggcaacgatgcggaaaaagacacggctggctgccgtgccttagaccgtaaatacattgtaataggaggaactccatcgtgaaacgcaccatcctgagatgcgccgccggcctgttgatagccgcagcgctgctcccaaccgccctggcggcggagccattccccgcggtcaccgaggtgcaggtctgctatccaacctctgtcacccgcagtgaggacggcacggagatccgcaaggtctatgacctgtccccggagcaggaccctgccggtatcctccggtcggactttgagcaggacggcttccactacaccctgacagacctgctccagcaggagctgccggagtgtgagagccgtccgcacacggaaacggtatcgttggagagtaaaagcaaggatatggaatccgtcctggccctgctgccccaggagaaggagttcgtcacggaggacggcctgtccggcaccctgtccctccagctggacactgtccaggtggaggcggcgggctgcggcagctccacccgggaggtgtccgccacccgctcctaccccaacctggccagccaggataccgccaacatccccaagagcatcgaggaggacgggcgtaccctcaccctccaaaatattgactggcggacggacaacaccgccagcatgtctggctacgccattggagaccgttacaccgctgtggctgcctacaccggcaccgccaccagcagctatgtcaccggctatactgtcacggcagactacaccggtaccgtcagccgcatcgccctgaaccgggtgcgttacgttgcaatttttgagggggaacccctggaacccgccgtacccatggaggggcctggggacggcctggcccagttcaactgggcggccatcctgcttccgctgggagtggtctttgctgtgggcggtgtgatcggcgcctgcctgttcgtcaagcggcgccgggaatccaaagaggaggatgcggaatgaagaagctgaccaccctgtgcttggctggctgcctggcggcggccctggccaccccggcaggggcattggactacaccattgacgcgccggaggggccggacttcggcaagttcacctcggtggaggtggtacatacggcagatggtggggccctgaaaaatgaggacatcagcaagaatgccgccctcatcccgccgggcttcggcagcgccagtgcggataccctgaataccggaacctggctcacgcccaacctggccccggagggcatggcagtgggcgccgtcaacggcagcgggatgccaatcgtgttcccgccctctgtagataccaacagctccactccggctaccgaggaggagcagaccacctccctcggctataccccggtgacttcggatctctactattccggcggatacctggggacattgagaatccccgccatcggcctgagcgtgcgggcctatgagggtacagacagctccacgcttatgaagggcgcgggacatttcaaaggcaccagcatctgggatggaaactgcgccatcgccgggcacaaccggggggtacgggatgactttggggatctccacaccctggaacggggagataccatcacctggaccaccaagctgggcgtccgcacctatgaggtcaccagtgtgcagaaagtcaaggagacggataccagcggcaccgcaccttccaccgagaacatgctcactctctacacctgcgtgtgtaaccagagggcctaccgctggcaggtgcaggcggtggaggttgtgtaacctgcttgagtttccgggctcattttctccacagggaactgctctttgctgtagacttttccccagatttccggtatgttgttgctgtaaggaacacaagaacagcagaggaaagaaggaggtcaaccgtatgagaaggaaacagcttattccggcggtattggcaggtaccttgataggcgcagcactggtggggcccgcgtcagcagaggtggccgccctcactgcagcaccaagcacccagaccttctatgtggacgggaaacaggtggatctggaagtgtatgtcatccacggccacaactatgtgcagctccgggacgtcggccgggcggtagacttcggcgtggcgtatgaccagggcgccaactgtgtcctggtagacaccagctccccttacacagaggaaagcgcggcgcctgccccctccggggtggtcaccatcccccagtcagatacgcccctccggctgaaggagggagacaaggtgctctgcgatgacggtaccacctatgagattaccgatctgaagttatgggagcccccggccccgctgcccacgccgacttgtgactggaaccagttcccagagttgaagctcccggaagtgcaggtgctgcgattccagagccaaactggggatagacttcatatcctgaacctctatgagacccggcggatgctgtataccctgtataacgccgtacccaactgcccggagttatgggaggctggagccatcaagctcaactctaagggggaacccatcctacgcttgtctatggggattacagagtccagcggtgtgcaaacattctggccctggcgggatgagcagctcacccgcgtcttctactccgccccaatggcacggtttgaggtggaagcatgggatgtctataaaaatgggaaatacctctatacggaatacaacgtaatgggtatgtaactacccacaacagaacgaatgatatggcaaagccccgaaacggccggttatgcaccgtttcggggtttctttttactctttttgaaatccgatgaggaggaaatactgtgaaaaagcttatatcgctcctattgacagccgtcctgatcatgggtctgctgcttatatctgctgccgctgcggatactccggaagaggctttgggcgaactggacatttatagtggtggatattctatgaactatctggccgtcaacggcaaagtacagacccagtcgtacacctacttcctctacgaaaataccactggagaaatccaggaaatcccagcgtactgtgtcaaccccaaccagtacggcgtgccccaaacagttccagagggggagagcatccgttatctggctgaggagaaggccagcgatcctaaggtggtagggctgattgccaacatgtacccccaccgctccttggaggaactggggctggataacaaatatcaggccttttacgccggcaagattgccctgtggtgttacctgatccccgagtgggacatcaacgacgtcaccgtggcccccggccttatcggctcagagcggacaattggagaaaagcttctggatgccacaaccaggatttatacccaaggcatgacctgggatcatgtggctgaaccccaaattacggtcactacagaccgggagcaggcgtaccctgtcacccttgacggagaagcatatctccagcaggtatttactgccacctcggatacttgggtggtaaaccatatcgtcaatatccagtttcaaaatcccggtgacgtacctgatggcaccagaattacagacatgaacggacaggatattacccaggtcaaggtctccaataccggagacggctacagtggacaatttaaggtgctgtatccggcggccagcgtggagggacggagcggcagcgtccagcttaccctttctgctgatgtctaccgctacgccgtttattatgctctctgccaggaaacggatgaatacggcaagctccagagctatctttgcgataccgatccccaaaccagcctgctgcgcagcgttatctccaactactcagatactgacgacccggacgagcccacgccccctcccggtgagactgccctcaaaatcaccaagtacgaggccggtaccaccgtcaccctggctggggcgaccttcgaggtggtgggcccggacggagacactatcggcatctataccacgccggagtccggttccataaccatccccctcactgaggtgggcaattacaccatctatgaacgagtgcccccggagtaccacttgttggatgaggagccggtcaagcagatcactgtgaagtatggcgaggtggccaaagtcgcctttgaaaacgaaccatacggcgacctgcgcattgagaaggttgacggggccaccggagccagcctggccggggcgcggattcaggtcaagcacattgagagtggcgcgacctataccggcatcaccggcaccggaggttcctataccttcacggagctgaagccgggggcatacgaaatccgggaactgtccgccccagagggttggcagcgggatccccagacctataccaccactgtggtggcaggggactgcgtcacctataccctgaagaacgaggccctgcccggcctgaagatcatcaagtacgaccgcctgagccatgagactatgcccggcgttaccttccgcatctggcgggatggggagctgctgggggactatgagacgaacgccctgggagaaatcctgctgacggactgccggccgggcacctaccgtgtccaggaggtggacaccggggacagcggccatctggtggatttcaccccgcaggaaattgaactgaaggccggagacagtattaaggagctctacttttttaacgaccagaagcccgggatctggctggtcaaggtggacagcgccgacccgtccaaggtgatccccaacgccaggttccgcatcgaggccgtggacggcaactttggcccggcggagttcaccaccgaccagaacggcgaaatcgacctgtctgaactgcccaccggagcttatgtggtgacggaactggactgcccgggctacatcatcgatgaggcccagcgcatcatccagatggaggccaaccagacagcccgttttgtgttcaccaactccgtccagccctccctgcacctcatcaagctgagttcggacggttcccggctggctggggtgaccttccgcatcgccaaaatcgaggacggcagccggtatctggaccgcaccactgatgaaaacggcgaaatcctgatttccggcttggagccaggggtgtattcggtcaaggagctggacaccacctcagaccacatcatcgacccggtggaacgccatgtggagctgttccccggcaagacctccacgatcatcctagagaacgacatccgccccaacctgacggtggtgaagcgggatgccgacaccggggagcctgtaccggacaccgtattcctggtggaggcggcggacggccacagcgtggatgaaatcaagaccggggcagacggaacggcaaccctggaaaatctgctgcccggggtgtatcaaatttcagaaaaatcggttccctccccttatctcatggatgcggagccccagttggtcaccctctatcccaaccggaaccacaccgtctatttcgagaaccacaaaaagcccacccttaccatccagaaggtagacagcatcaccggcagccccatccagggggccaaattccagctctggtacggcagcaatgacaccgacaccggcgagctcaacaacctggggatctacttcactgacgccagcggccagatcgtgttggagggcctgcgggacggctggtaccgggtgacggagctggaacccgcccccggcttcaccatcaaggagcctgccacccaggaggtctatattgagggcggcggaaacaagtctctgacatttgagaacgtccccctcaacgccatcgtggtacacaagacggacagcgtcactggcgaggccctgggcggggccaccttccagctccgctacctgggaggtgcctccggtaccggcggcaccatgatcggacagaaggtgaccggctccaacggcatggccatctggacgggcctgaagccaggatcgtacatcgtggaggaggtggatccggcggaggggtacagcatcatccagtcctccgagaccgtctacctggcagacaacggggagcagagcgtcatcactgtccgctttgaaaacatgccggacgggaacctcctgatccgcaaggtctgcgctaccaatcccagcgagaccctgcccgacgcagagttcaaaatcacctatgcggacggcaccctcattggggacagcaacggaatttttaagacagacgagaacggcgagatcctgatctccggcctccagcccggaaagagcgtggtggtgacggaaacccaggcccctccaggctacctcatcgatacccagtcccagaccgtgcagatcaaagagggccggacggtcagcctgacctttaagaatcagccgaagggtgagctgatcatccagaaacgggacagcgccaccggccagccgcttcccggcgcggagttcagaatcacgaccgccgccggctgtgaggtgggcctggatggggtgatcggcgacagcacgctcacccagaacggtgtgtttaccactgacaacaatggcgaaatccgcgtaaccaacctggcccccggcgcctatgtgctcacggagatcaaggcgccccaggggtacgtcatggatgccccctccaccaatgtggtcatcggagagggcggagacacccaaacggtggtcatcaccaacacccccaagggcggccttgtcatcaacaagctggattccgtcacccatgagcccctggagggggtagagtttaccatcaccgaggcggacggcacggtggtggacgacaacggcggcatgacctccagcatgggcctctaccgcactgacgaaaacggccagatcatcattgacggtttggtggggacattcctcgtcacagagaccaagaccatcgagggctacactatccatgaggagacccgcacccaaacggtggtcatcaaccccaacgaaacccagaccatcacggtgtataacgaccccatcggcggcgtggagatcatcaaggtcaacgcggactacaccagggagcgcatccccaacactacgtttgagatccggcgcatggacggcgctccggtggacaccgtgaccacagaccgaaacggccgggtgttcctgcccctggaggacggatcctactacgcggtggagatcgagagtgcggagggcttcaagctggatgatacccccgtgtactttaccgtggagaacggtaaaactaccaccctccggatggagaacacgccggtcagcggcatcctcatccacaagacggacagcgccaccggcgagggcatctatggggtgccgtttatcctctatgacagcaccaacacccccatcggccagtacacctcggatgaccgggggtacgtgctcattgagggcctggaggccggccggtattatctcagagagttagagaatgagggctacgtccccgacacggagaaaaagacggtctatgtggagtccggggaaaccaccgaggtggagtgggagaacacccccatcaccgggcagatccaggtgaccaagacctcagcggactacaacagtgtcaacggctggcctgccggcacccccatccccggcacggagtttgaaatctacaacgccaggacggggaacctggtggacaccatccagacggacaagaatggcgtggcctcgtcccggcctctgcccttgggccggtacaaaatcgtggaatccaaggccgcagacttttacggcctggacaagacccccatcgaggtggagatcgagtttgccggccagatcgtcaaggcggccatgaccaacaagagcctctacaccaatgtaagcatccaaaagaccggctatgtggaggtcatgcccggccaacagatccgctacgatttcagcggcatcgccaacaactccaccaccagtctcacatcgttctattggcgagacactctgcccggccaggcggtgcggctggacaagattgtcactggcacctacaacgtgccgggcaattatagggtggtctacaagaccaacctgagcggcagcacttggcgcaccttggcggacaacctgagcacccagcagaactatgtattggacgcctccaaggccgccctgggcctggcctccaacgagtatgtcaccgagttcatggtgtccttcggcgtggtgcccgccaacttccggcaggtggaggcgccccaggtctatgccaccgtctacgcctggcttaccggtggcagccaattcgtcaaccaggcggatgtgggcggcgtgtataacggccagtggattatggccacctcccggtgggtgaccaaggtctacaagcccgccgagcccctgccccgcaccggctattgattccagcaaactatcgttagaagggccgccccagtcgggcgaccctccaattttatggaggtgtcagaatgagtatcagaaaaaagggaatccgggtgctgctcctggccctgacggtggccgccctgtgcatggtcccggccttcgcctcctccgccggcaatgtggcggacgccgtagagcagacctggacggatgccgccggccagatcaagactgtggtggatactgtggtgttccccgccctcaccatggtgctggggattgcattctttgtcaaggtggcactgtgcttcttcgactatcgcaagcacggccagtttgagtggacgggggcggccatcctgttcgtctgcctgatcttcgtgctgctggcccccaattacatctggaatatcgtaggcatctgaggcggtgaaggcgagtgtttatttgggactttgtggccaatccggtgatggagtccatcctggactggttttacagccagatggtgggcttcctgggcgccttcttcgcccagatgggaaacatgggggtggagctgttcgacctctcctgggtgcggtcagtggtgcgcttcttctcccagctgggttgggccctttttgccgtcagcgtggtggtatctgcctttgagtgcggcattgagtacgcatctggccggggcaatctccagcagcccgctctcaatgccctcaagggcttctttgccgtcagcctgttcaccactgtgcccgttcggctgtacgccctctccgtctccctccagggtaccttcgccatggaaatcacaggggcgggaaagagcatcggggagctgggcaatgaaatcctcacaggccttgagggggctggcctgacggatatcgcggcccaggccaaatggggcctgggtaccaaccccatcatgctcctcttcgccatgatcttcatggcctatgcggtaatcaaggtgttcttctcaaacttgaaacggggcggcatcctgctcatccagattgccgtgggctccctgtacatgttctccatcccccggggctatacggacggcttcacccagtggtgcaagcaggtcatcggcctgtgcctcaccgccttcctccaggccaccattctggtggcggggctcatggtattcagtgacaaagccctcctggggcttggcctcatgctggccgccggagaggtgccccgcatcgccggggccttcggcctggacaccaccaccagggccaacatcatgagcgccgtctacaccgcccaggccgctgtcaacaccacccgcaccattgtccaggccgtcaaatagcatgttgcttatgcttggtttccggcgagatctttgttggtgttggtcatagctatttgccggtgagatcgatatacttgctttaccaaacggaaagggggccaatccatggcagaaaatataaagaacctctgtgctcccgtccccgccgggctccatgcccgggtacgggaggcgcaggaggcgtccggccagacactgagccagtacatgacgtggctgatccagacattctatgaaaatcaaaataaggaggaacacatgatgaacacagacaagagaacggtggcattccaggtgcccggcgagctgttcgagaagtttaaggactacctgcaggagcggggtatcaaacaaaacgccttcttcctggactgcatccacagggccctggcggaggccaaggaggagcaggtggatgcggatgcctctgcagagcctgacggcgaggccgagacggatgccaccagtcagggcgaggatgcagatgaggacagcacagcggaataaacccacaggaagggacctggccggacaggctgggtccctttctgttttggaggtgttttcgtgttcatctacccagacaatctgaaggccaaggccgccctgtggctgtggcagctgcgggacgtggccatcatcggggtggcctttctgctctctgtattggcgctggcccagacggggaccatgctgcccctggtgggtaccgtgctgtacgccttcctcgccatccaggtggagggctccagcgtcctggacttcctgcggcgggcggcctgcttcctgttcctgcagcagcaatactatgaatgggggcagaaggttgaaacattgtagtctaagtaccattccgaaaaaggacgcataaaaccaagcccccaggaagcgggcaaatttcaggttatatttaggctctaagtaacgctgggcgcagtcaccaaataaccctgccgttgaagaataaaaattgcttcttcaacagaaacctcacgatgtgtgggaggccggtctgcctgccggtatagttcaggattgtaaggctcatttttcttgagcatattgtagatagctgtaaggagcatcctggcaattgcgataatggctttcttgtgtccccggcgctttttgagagcgagatagcggttgcggacttccgggaactgcttggctcgaatggcacagagcgcgcattgcaccagcaagggcttgatgtaggctccggctcgactgattctggtggttttcttcttgccggcactctcgttgttttgcggcgtaagcccagcccaggaacagagatgctttgaggtggggaacacggacatatccactccgatttcagagataatgccgatagcggcaaaggattggatacccggcgccgacataacaagattgaactggggaaggtatttctcagcggtggacagaatcagggattccagattgagcttgcacagttccaggctgtccatgtgggaacggatgatgcggagcttttcagcctgttcagcacacatctcaccgtctacggcggcaagcacctgttcgtcagtcgctttcatgcctttggttcggaaaccagaaatatccgtaattttctccgttggatcttccagaatacgggcagtgattgcggaggctgccttaccgaacacatctgagaacacatcatccagtttgaaattggagactgtcaggcagttttgcgcccggtttttctcgccggtagtaaagttggtgagtttccagcggtaacgtaccaaatcccgaagctgacgaatatctggcggagggataaaacttccggctacaaggtcgtgcttgaagatgtcggcaatccacttagcgtcccgcttgtctgttttcttaccccggatggctttcacatatttggggtgagcgaggacaatattgcaggtgtgctccaggatgttgtaaatgggaatccaatactttccggtagattccatgcacacatctttgcagttgttttcggccagccaggcagcacagcggcgcaaatctccggtaaaggtggagaaccgcttgctcttgtaggtcgtcacgccttgctcattggtagcagcgatacaggcaacgacaaaggatttgtggacatccatcccgcagcagacacggtaaacgattttgagcatagcacatcccctcaaaacaggattcgaggcaacaggcagggactggatgctcattgaaagattgaagtagtccgtctctccaaagataaggttacagggtgcaaagccctactcattggtgcttgaaagagcgtccggcacacataacaattcagtccagctaaagctaggcctactcacccccacgtgctctgtagtatgcctgcttcctcaagtacagtttaacaaatttggacttgctgcgttagtggttccgggtttcattccctttggtgccttgaagcgtagcggaaaggaatggtcataacaatgaatagaaaggaacagcagctcctgcgccagcggcagaccacccggcagctcatgggtgtcacccatctgacggagcacggtgcggtgtgcggcagggatgagctgctcttctacctgctccggccggacaatctgtccatcctgtccccggagggcatccggggccgggtgcgggccctcaccgggcttctccaggggatggcatccctggagctgctggccctggactccagggagtcatttctgaaaaacaagcagtattaccagaggaggctggaggaggaaccgtctcccgccctgcgggagctgctccggcaggatatggagcacttggacgcacgccagtcctccaccgccgcctcccgggagttcgtcctggtctgccggttggacagcaaggccgcagaggatcgggagctgccccggcgattggagaagcagatccaggatcacggcttttacgtttgcctggccggggaacaggatgtgaagcgcatcctggcggtgtactaccagcaggacatggtgaccgaacactttgacagcatagatggagagaggtgggtgacagagcatggctaaagcacagaagaagcggaaaaaaccggtggaaaaaccagcgcagctcttccagcccaaggactttctggatcggatcgccccggcggcagtcaaattcaacacggactcctatgtgctgggcgggctgtaccgctgcgtcctggccctccggggctaccccgccgccaccgaggagctggccctgctctcccacatctgtaaccgggccggcgtcaccctccatctctatgcccgccaggtgacagcggcagaggaggacgccatctaccacaaagccgtcaacaagaaccggctggatcggagcaatcaggacaacctgaagcggagtgtcacggcggaggctaacctccaggatgtgaccgccatcattgccggcgcccggaagaaccgggagcccctcatccactgcgccgtgttcctggagctggccgccaaaacccccgaggagctgcggctgctgcgggacgaggtgggcgccgagctcacccgggccaagctcagtgcagatcccctgctcctccgccagcaggagggcttcctctccgccaacccggcggggcggaacgccctgggcgcccagtttgagcgggtgctgcccgccagctccaccgccaacctgtaccccatcaattactccggccgcagcgatcctcacgggttttacatcggcaatgaccactacggctcggacatcctgctggatctggaccgccgcacaccggacaagaccaattccagcgtgctcatcctgggcaactccggtgagggcaagagctacctgctcaagctgctcatctgcaacctgctggagagcggcaagacggtgatctgcctggacccggagcaggagctgacctggctctgcggcaaactgggcggctgttacgcggacctcatgggcgggcagttccgtatcaactttttggaggccaagcggtgggatgttggcgacgacagggatgacgatccaactgtgcccaatgccttccgccagcaatctcccctgtcccagcacatctccttcctcaaggactttttccgggcctacaagcccttcacccaccaacaggtagataccctggagctgatgctggagcggctgtaccggaagtggggcatctcggacaaggcggacttctctgccatggggccggaggactggcccaacgccgaggacctgtacgccgtcctggaggatgcctacgagcactatgaccaggaggacagcccgctgtatcccagggaactgctgcgggagctcctgctggggctccactccatgtgccggggggcggagagcgtctacttcaacggccataccaatatcactagcgcccgcttcctggtgtttggcgtcaaggacctgatccatgccaactcctccgtcaaggacgccctgctgttcaacctgctgtcctacctcagcgaccagctcctcaccaaggggaacactgtggctgccctggacgagctctacctctggctgtccaacctgaccaccattgagtacatccgcaactgcctcaagcgggtgcaaaagcgcaattcctccctgatcctggcatcgcagaacctggaggatttcgacatccagggcgtgcgggagctgacccgccccctgtttgccatccccacccatcagtttctcttccacggcggtaaggtggacaggaagttctacatggacaacctccagctggagagcgccgagtacgatctgatcagcgctccccagcggggcgtctgcctgttcaagtccggcgcggaccgcaacctgctggacgtccatgccccgccccacaagcatgtgctgatcacaggaggagatggatgaacgtggtgggctatggcggcgggacaaacagcacagccatgctgatagggctttggcagaggcgcatcccggtagacctcatcctctttgcggaccccggcggggaacagccccacacctatgcctatctggaaatcatggaccgctggctggcggagcacgggatgccgcccatcacccgggtatggtacaccacccgggacggccagcggctcaccctggagcaggaatgcctccgctccgcttccctcccctccattgcctatggctacaaaaagtgttccctcaagcacaaggtgtccccccaggagaagttctgccggcacgacccccactgccagaaggtgtgggccggcggcggccgggtggtcaagttcatcggctatgatgccggggaaccggagcgccgggagcgggtgcgggagcgggacgaagcggaccggaaataccagaaggaatacccccttatggagtggggctgggaccgggacaggtgtatccaggccatccaagaggcagggcttcccctgccggggaagtcctcctgctttttctgccccagcatgaaacggcgggagatccgcaccctctaccacagatatccggagctattaggccgtgccctggccatggaggacagggcacggcctcatttaacctctatcaaaggtttgggccggaactgggcctggcgggagttcctggagcacgataagggacagctggcgttcccccaggtattcccggaggacaacctgccctgttcctgcgggggggggcatcacatgagccccgccatcttagtcaaggctgccgcgtccatccttaccaatgaaaaaagccggaaagccgtggggtgggtgctgacagccgtactctctcccatcattctccttctggccttcttctgcaccaccttctcaggaggggcggagcacaaccgcactgtggtggatctgtgcttccacggcggggccgtcccggagggaaccccggcggagtatcaggcatacatccaggagatgcgggacagctttgccctgctggatgccgccatgcaggccgtggaggggcagatggaggagggggacggcctggatgacatccgggtcaaggcggtgttcttcgctctgtacttcggcacggatgacccggcagcccatgccggacagacctttgtggattgctttgtcacctatgaggagcgcacccgtacggtgaccaccgtggatgaggagggtaatgaggtggagacccaggagacttataccatggccgtcccgatttcagatctccagcagatctggcagaacctccaacggcttacagggacggaggttagcccggaacagcaggccaatgcggacagcgtctacaacattgtgaagtatggcgtgtccaccggcacggagggctggattccaggcgcggacgtgcccttcattggggcggacggcttctgctcccccattggtgccgggtgggagagccgtgttacctcggagtttggttaccggagagaccccttcaccggggagacccggggccacaccggcatggatttggcggtacccaccggcacccccgtccgggccgccctgcccggcaccgtcaccgccgcccagtaccacagcagctacggctactatgtgatgatcgaccatggcagcggcctgtctactctctacgcccacaattcccaactgctggtgcgggtgggacaggcggtggagactggcgacatcgtatctctgtccggcagcaccggccggtccaccggcccccacctccacttcgaggtgcgcgtcaatggacagagaacaaaccccagatactacctgccaaccacatcatacgaggagtgagagaatatgaactcaatccagaatacggcttgccttattgccgcctatgaaacggcggcggggctgccggacaacgaacggatcacccggacagatggtacatggaggccgggggtgacggagcagcaggcggcgtcactttaccggcaggcacaggccctgctggctccggagaccaagctgctctccacaagccgcgagtcactgatcgaccagatgcgggacgctttgctgtccagggagctgtccgtgggagacacggtgctctttgccgccacagaaccctatggcggtcctggagactttgccctccgtggcggcgtcatccagtccattgacccggaacgcaaaacctgctccgtacagggacgttttttcccgatggacgatgttccccttcactatgtattggggcggtatgatttggacttgcatgagactcactacggcgtcccctgtgtccagcctctgatgggtgaacaccctgagctggcggagcggtatctgcgtgaagcagaggcccggtggaacacccaatacgggccaccggcagcttcatcagaggccccgaaaaacacaatgcaggcgatgggaggcatgagctgactatggaaaaaacagaactgacggtgagcatggaaccggagcggctggacgcgctccggtattttctggccgccaagaacaagcgcacgcctcagaaggagctccagcgggcgctggaggagctgtacgaaacctacgtcccggccgaaacccgggcctatctggacgcccggtgccggccggacaggcaccggccccggcggccgacggcatccaaggtcacacagatgcagaaggaggaagcgacagatggagaccattgaactgagcggccgcactggacaggaggtctatgaggagctgaagcaccggttggagggcatgggctatctgccggacgagtattttctgctggacgccgactgggaggacagaagggtgatccccaggaatgcggatctcttctgcactacggactacggggacagcgaggggatttacctggatgtgtacctgaagtggtacggggaggacggcaagcctgtgatcaaaggcttcgccacgggcaagaccctgggcgagagcggctccgacatggactggatgttcctcatctcctccgccattaccaaggcgtttcacggtgagcaaggtgcctatgccagataccggcagatggaagacggcacgaaggcggagggcgtggtgctccatctcagtccgaaggagcagcgggtactcatggatgcgctgctggaacagcggatgcggcaggaggcacagatgacgaatacggagcagctcctgcgccgtatgaccggcagcatcaccgcctatatggacgaggtgggcgcccgccccctgcgcatgagcacggcggaccgggcggtgctggccgtccgggatggggagctctatgcgttttcttccctggcagttcagatcacgaagccggaagagcggggcagcctgctggccgcggcggcaggcaggccaggcccagtgggcaaacggatggccagactgatgcttgggacaaagtcaccctacccggaggacgtctggttggatgcctgcaaacgggcggtggacaccggggatctccagcgggtgcagatgatgctggatcagacaatggacaaggtggccaatccgtcccccgccctgcccggtgaggtgctccggtatgccttcgggcagaaccgcgccatggccagagagcttattcgctgggccatgccggagcaggttgccgccgcaccctccaggctgctgtgcagcgccgcctatgcccgtgatctgcccatgctcacggaactgctccaaaagggcctccagccgggggaccaggccgccccactgctgcgccctctgttcgctgcatacgacgagcagagggtggcacatctgctaagggacagcctgcgggtgcagccggaggactatgaggcgatgaacgtgtgtctgcgggagcaggcgcaggcggcggcggaagtcctgctggaacaggggatgaagctggacggctacctggcgtgggcggcaaaacagaacgtccttctggacacgcaggcccaggagatcctggaccgcctggcggaacagcaggcccaggtaaacagcgcgccggagcagaatgggcctgtactgggagggatgagcctgtgagtgttcccgtactgacccaccgcagggatctgcggcagggggatttggtgttcccggaggagatcctgcgcatcggccacacgctggatttccagctcgactgtgtcagcaaagaagttcagcaggaggtgtttggcccggagctggataccagttcactgtgtgattggctgaacctccatactgcctatgattttgcgcttcaggatgtggtggaccacatagatataaccctctgccggaattttggagaggaggagcacccattcacgtatccgctcaacagggcggagcgggacgtcctgcgcggggagatggaggcctgctgtcagcggcgcaccgaccgttctctggcgcagcagtacagtcatctgctgacaacggaggaagccgagccgccggagctcacggtcgggacacaccggctgcccatgggggaggttggcttcgcggaggatctgtccgagtgcggtgggctgctccagttctatatgccggtgacctttgacccggacgcggtctttggcacccacgtggcgaccgcggaaaacgacgactggctcaacgtgtacgccgcctatgacctgaacgccagccagccgtgctccgcactagacgtcatcctggtgtgcggagacggcaatgagtccgccttccggtatccgctggccaagcaggagcaggccgcgctgctggaaaagatggacgcctactgcctggaacagaccggcatggcgctggcagatttccgggcccggtatctggtggaggaaccgcagccccgccaggcccccagcctggcccagctgtgagcacgccgtcggccccgtgtgcgccctgtgtgacgggttcaggcggagggcgggccagggccccgcccagccgaaaaaccgccccgttggggccggtttcgccccgacttggggcgttcgattttagtacgaggataaaggagcgccgtggtgagccccggcgctcaggccacaaagccccgcagtgcggggcttttcccggatttgggtaccgccgtcggtaaaggcccgttccgggttttagagcggtggtgcgtttgaaaaaacacggcgttgcaggcggttgaggcccttttgcaccgccgtggtgaacgaggaggaagcatggacgaggaaaacaggctgaaaatcaccctctggctcaagccgggcattgtccgccggatggacggctggctggaggaggacaactgcaaaagccgcggggagtttgccgaaaaggccctgcggttctacatgggctacctggccacggaggacacctcggagtacctctcccgcgccctggtggacaccctgcggggtacattggcggacaacgagaaccggctgcgtactttgctgttcaagctgtgcgtggaggtgaacatgatgagccacaccgttgccgcccacttcctcgctgatccggtgaaccgccgggagctgcgggcctatgcggtggacgaggtactgcgtaccaacgggaagatcagcttcgatgatgcgctggatctccagcgccaggtctaccctgacggatgagccgcatccgcttcatgtccccctacctgaagggcggaagggacacagccaagctgtccaaccgaacacgctacattgccacccgtcctggtgtggaggtgctcaggggtaaacaacaagaccagcccgctacgaaaaagcagcaggcttatatccagcacctgctccgtgacttccccggcgcgaaggaattgctggagtatgaagactactgcaacgcgcccacccaagcaaacgccaacactttcattcgccaagtgcaggaggacttcgcggagcccatgcgccggatggagaactacctggactacgtgtcccaccgccccggcgtgcagctgaacggtgagcacggcctgtggtgcgccgggggcaaggtatgcaatctctcccaggccgtccgggaggtggcggagcacaccggcagtgtgtggacgccggtggtggccatccgccgggaggacgcggaacggctgggctacaacgacgcggagagctggcggcaactggtgtgcgcctgcgcgcctgagatcgccagggggtataaggtcccgctggagcacctgcgctggtacgccgccttccaccgcaaggaggacagcgtccatatccacatggtggtgttctcctccgatcccaaggagggctacctcaccaggcagggtatccagcaggtgaagtccgccttcggccggcggatcttccaacaggatttgctccacgtctacgaacagaaaaccgaataccgggacgctctgggccgggatgcggagcgcaccatggcagagctgatcacccagatggagactggccagctccaaaatgaaaacctggagcggctggtgctggagctggcccagcggctgcacaacacccagggcaaaaaagtctacggctacctgccacccaaaaccaaagcattggtggatgccatcgtggatgagctggcaaaggacgagcgcgtagcagccgcctacaacctgtggaaccagatgcgggaggaggtatgccgcacctattctgagcagctgccggagcgcctacctctttccaaacagaaggagttcaaggccgtgcgcaacatggtcatacgggagatgctccggctggggcggggggagcatcccacagcagatgagatggtatacatgcccacaccgtcgggcacatcgcctgcaccatccgatgtgcagcgtaggggacatcacccacagcaggaggccgcacaccaccagcatacacagacacattgggcggtatcccacgcggataccgcccaatgtgtcctcatgctgttccacaacatgggccgcatcttccaggagcagtccgccgcagataccatccaggccggcctgcacatcgacaagaagcgtcgccggatgctccgggagaagcgtatggccctaggacataaggcggatgaccatgaggaactgcggatgaactagtggggctcggatcagtccaagccccaacttcaactattcatccaacttgtgaaaggagtcgagtcgaagctcccgcttcaactcatcctccgtgggcagataggttttgtacttggaggtgaagatctgggtgttgttttccggcagcgtatagcgtaccaccgcgtcgtttttctccgcacacagcacaatgccaatgggcggattgtccccttcattcatcatctcacgggtgtagtagttcacatgcatctgcatctggccgatgtcctggtgggtcagggtatctgttttcagatcgatcagcacaaagcacttgaggatgtagttgtaaaacaccaggtcaataaagaaactctgcccgtccagagtaaaccgcttctggcgggagacgaaggaaaaaccgcggcccagttccaggagaaactgctggaggtgatcaataagggcctgctccagatcactctcgtagacatgggtatccggctggatctgaaggaattccatgacatagggatccttgacgatcttctcgtactcaggcttgggttctctgcgctgaatctccgcagcgacggacgccttgtcctggctggccaggatccactggtaatacatggtgttgatctggcgctccagctgacgcacactccaggccgatttggcacactcctccgcatagaatgcgcgtgccttctcgtctgatatacgcatcagcaggcggtagtgggaccagctcaattcgctccacagtgtggagcgaattgggaacgtgcaatagaactggcgcatatttcggagcccctgcacactgaagccttttccgaattcagcagtcagttttgcggagaggtattctaagagcctgattccgtactccgcccggtcattttctccacacgctttgtagatctgctctccgatctcccaataggcggtcaccatggcggagttgaccgctttggctacggagtgctgggcagtcacaatggagccgcggatggcgtggtaggtctgctctgggctgacagttaaaatctcatcctgcttgttcatggtcagcctcctggcacagtcaaattctgtttcttttattttacacaatccagggaaagacagcaaccaaaaccgaggtgatttctcacgggaacctatatccactttacctctgaacagaaggagcaggccaactccgttgatctggaggagttcctgcggcggcggggggagaagctgctccgcgctgggcgggagtcccggctggccaggatccgtcatattactgtccggggcagcgaatggtacgaccatattgcccggcggggcggccacgcggtcagttttgtccagcacttttacggaacaagctaccaggaggccatggagctcctgctgggaaaggagttggggaaggcatatcccgccgcgcagccaaagcgggaggagcagcccaggcccttcgccctgccgacgccccacaccgatatgcgccgagtgtatgcctatctgatgaagcagcgccacatcagccgggaggtggtcacccactttgctcgggctggcttgctgtacgaggacgcgaagtaccacaactgcgtctttgtgggtacggacgagcagggcgccccccgccacgcccataagcggagcaccaacagccagggcaagtccttcaaggtcaacgtggagggcagcaggccccagtacagcttccgccacgtgggacaggacggcctgctctatgtgtttgaggccccgattgatctgctgagcttcctcacgctgtacccggacagatggcaggagcacagctatgtggccctgtgcggtaccggcggccaggccatgcattggatgctggagcagaacacccgcctccgggatgtggtgctctgcctggatcacgacgagcccggacagacggcggccaagcgcctccaggaagagttgcaggaagcaggataccacagcggcatcctgctccctgtgcataaggactggaacgacgatctggtgcaggggcaggccatggctggccctgccatgactatggggcagagcatgtagccccatccccgtgccgaaatcgtaccatgcccgccaagggggtggtgcgccctgccgctggaccgggccccggttcatcctggcccaccaaagaaggtcacactggaagatagatcaaacacagagaatgaccagaaagagggagatatacacgtgagtaacgatacctggacgctgattctcctgttggcagcagtattcggagccctggcggccatcgccgccttctccagccggggcagcctggacagcatcaagagcaaggacgtgggcgacggccagcacggaaccgcccgctgggccacaccggcggaggtgaggaagaccttccgttccgtgcccttccagcccgcgctgtggcggaagggggagcagctcccggacgcacaggggttggtgctgggctgtgtgggaaagctcccggctccgccggagttctctttgcttgggaagaccgtccatccgctcatcccagagaagctgtggaagcacggtgggattcgggccctggtagactgtgacgacatccactgcctcatgatcggcgcctccggcgtgggcaagaccgcatatttcctgtaccccaatatcgagtacgcctgtgccagcggtatgagttttttctcaagtgacacgaagggagatctggcccggaactacggcgccatagcccgggactgctacggctaccaggtgtcggtggtggatcttcggaaccccacccgctccgacggctacaacctactcaccctgatcaaccactacatggatgtctgccggaaagatcccaccaacctggctgcccgggccaaggcggagaaatatgctaagatcctgtccaagactatcatcaacccagacggggagaacttcgcacaaaatcaatatttttatgatgtagctgagggtgtgcttaccgctgtgaccctcttactggcggaatatttgccgcccaaaaggatccatagtgagctgcgggagcggcggcacatcgtgtccgtgttcaagctggtgcaggaactgatagcccccagcatcctgccgggcaagaacgagttccagctcctcatggaccgcctgccggaggagcacaaggccaagtggttctccggctccgccctcaccgccgccgagcagtccatggcctccgtcatgtccaccgtgctctcccggctaaataccttcctggactcggagctggagcaggtgctctgcttcgatagcgccatagacgccgagagctttgcctcaaagagatctgcgatattcctgattttaccagaggaagatgccacgaaaaatttcatggctgggctgatgatccagaccctgagccgggagttgttctccgtggcggatgagcacgacgggaagctgcccaaccgggtggtatttttctgtgacgagctgggcaccatgcccgccttcgacatcctgcccctgttctcggccggccgctccaggcggctgaccctggtgcccatcatccagtctctggcccagttggagaagaattacggcaaggaaggggcagagatcttgactgataactgccaggacactatttttggcggctttgccccaaacagccaaaccgccgaggtgctgtccaaggccctgggcagccgcaccgtgatgagtggttccatctcccgggggaagaacgataccagccagagcctccagatgattgaacggccccttatgaccccggatgagctcaagtccatccccaagggacacttcatcgtcatgaaaaccgggacccatcccatgcagacccgcctgcggctgttcctggagtgggggatcacttttggggagccctaccaggtgcccaagcgggcagcccggaaggtctactacgccagcaagtcggagctgaccagtgccatctaccaggcgtttcccctccggacagggacagtcaattatcatatgggaaaggaacagaaacagaaatgagctacttcaatgagatttacaatgacccggagctgaacgccagggccaagcaggtgctggtctacctacatgaccgagcaaacaaagacggcgagagctggtacgccataggcaccatggcaaaagatctgagcctctcccgttcgaccataaagcgggccctggcggagctaatccgccagggccgggtggagaaacaggcaagatttcgggagagcggggggattacctcgaactgttaccgaataaaggtaggacaagctgaactgactgatgagctgtctcggacttaatccgatttgatagcaatcacgagttgctgctattcaaaacctgtacatctgtgcaggtgcttacaagatggccgctttcaaggctttatcaatcaaaagcagtagtctattctccgggcacgcccactgcgtctgccctgcactgcctgcagtgggtgaactgggggatgtggacacgggccctggcgcgcagcgcctccaggagcgcccggctggggggctcatagccccgaaaatcggcttggggaatgagcggcatcaggttcatgacggcggctcccgcacgggcggcccaacaggcgatttcctcaatctccccggtgttgacgccggggatgacgacggtgttgattttcaccgtaagtccggcttctgcggccttggccacgccctcctgctgagcggagagaaaggctgccatggctccggcatccgcgctgccgcccaccgtccggtagacgtgcccggcacagacgacggagcgggtattgacagtgaccgtcagggtggaaaccccgcagtccagcagttcgggcaaagcatcagacagaaccagcccgttggtgctcaggcagagcaggagtctgggaaagcgggcgtgaatcaggcggagggtctccagggtggcggggttggccaggggctcgccgggccccgccacccccgccacccgcagacggctgtccaggcgcagggcgcgctccacgcggtccagggcagcttcgggggagatgacctccgaagtgacgccgggccgggactcgttggcgcagccatagcggcggtcgcagtagccgcaccggatgttgcacctgggggccacgggcagatgaatccggccatagcggaagtgggcctgggcggagaggcaggggtgctcggccggaatcaaagcggggccgccttccggcagagcgcttccagcccgtcgtcgctcatcggctccgggatgcagccgccgcggttgtccaggaggacggacgccagggcgcggaacgcctgggcgggcgcgctgtccggcgcgctgtccaccacggtttggcgctccagctcggcctggccgatgaggggactcatgggaatttttcccgccaccgtggtgcccagctccgtcgcaaaggcttggagcaggccgtcgttgtccacgctgctgcgcccgttgtggatgatcccggccaggcgtattccgccgctctgggcgtatttgcggatgccccggcagatgttgtttgcggcgtagagggccatgaagtcgctggtggtgacgagatacacctcgtcggccacctgctcccgcagcggcatgctgaacccgccgcagaccacgtcccccagcacgtcgtagagcaccacatcccggtcatccagcaggccgcggctgcggatctcctccatggccacgataatgccccgcccggcgcagccggtgcccggctccggcccgcccgcctcgatgcagcggacgccccggctgtccgtgaaggcgatctccccggaggcgccggtcttgagctggtcgagaacggtggggatgcgccgccccatcaggccccgggtggagtccgccttggggtcgcagcccactaccgccacccgtttcccggcctgggccatggccgccgccaggttggacacggcggtggacttcccgatgcccccttttccatagacgcagatgcgtttcactgatagagcgccccctttaaggtgcggccgttcatgatgccgcggaagatgtcctccagaagatggagggttccctgcccgcccaggtgggggcggggggtcagacagacctcatcaaacaccgggtaatccacgcggatcagcggaatttccagctcgtcggcaccgtcctgctcaaaggaggagccaaacagaagcgccgcctcggagccgcgcagctcccggtagaagtcctcctggtcggagagctcctcccggcgggcaaagcacaccacctccatccccagctcctgctccagaaagcgccgcagaccgtcggcccgcggccccgaggcgaggatcgcagctggcatgccgtagagggcctgtaaatagcggtaggcttttccggctccctctgcaatctgacggtccagctccgcccgggcctgatgataatccagaccgaagcggcgctccagccgactccagagatcgtccgcgccggcggcgccataggggtaatcaagttcctcccacggtatgccgaagtactccttcatggcttgcgccagctcacgcccctttccacggagcaccaggttcacatcggcatagggggcgcggcgcacttcctccagcgtacagcgggagagcacggcgcccagtgcggcctggggggcgagcatagcccggagggcctcaacatcgtcggcggcgtgggggtcatccatcccgagcccgatcagattaaccaggggacggggatcagaacggggatagggccggggataaggccgggggaccgggggcttcatcagcgggagcagtgccagccatccagcctccagcccgcgagccgcatccccacggaagcctgccgcctccacatggagcagcggcgcctcatgggggatgcgggctaagacggcggggatatcgtccccaatcatctcactcacacagccgctgaccacgaacaggacggacggttggaagagctccagcgcggagcggacggcccgctccagggaggcctcgccgctgaacaccacgtcgctgtcgctgatgacggtgcaggtctgccggatatcccgcatatcctgggcaacgtggagagacatggagccaaaattgcagcccaccacggagtggagcagaacaacgccgtcctgaattccacccaaagcctgataagctccaaagagcttgcagccgctggccggcctcatacggaatccccctttcgattgagccacattctggaccacatttccttggcggccagattagactgattacagtacagtgggtaatggcggctttggaagggcattttccccagcagaagactgctgcgctccgtcccgtgctccaggcggcggcacatcctacgcaccgtgcggacataggagggaaaggagagggaggtggtttcgttgaccgcggggatcagcggcgcgcccatcccctccaaggtgaagtcgccggtgcccaccaccacatccgcctctgcgaagattccgcgcagcgtctcctctgccgggttcaggaggagctgtgtctccgggctgtagagggcggcggcctcccgtacccgggccagcaggctgtcctccagcgcgggggtgacattcaggtttttacggctctccggggtcaggatgacacagagatgggagaccgacaggccatagtcccgcacataggatttgagctcgaagggagcctgctggatgctgcggctgacgagaaccgcccgggcctgccccaggcggcggcgggcctccgccgtctcctccagggcccgggcccgcgccgccaggacgacgggctccaccgccgcctccatgcggagggcctgtccaatgtcccggtaaaaggtgcagattccatccagtccggcgtagcgtcccgcgccgccgatgtgaaggtatgcggttccgaatttctcccgcatgcgtctggcccagcgaacccgcttgaccagattcagttccgcggccggggcgtgtaccagagaggagaggggggcgctggggatccacgtgttcacctgaatcccgcagccgttcaaaaagacctccagctcccgcagggcggcctttccctcgctcccccagcccaccgtctcgatgttgatgctgtgcgggatctgagcggacggctccatcacctgctccaccagggcgtagagcgcctcggtgaagccgcagccctttagctccatctccagccggttgtcgccggtgatggtctggtgggccagctctttcagacggttccgggtgtagtttttgtcccggtgggagaagagctccgactggacgcccactaccgaaataccctcccgccgcagctcggcgcatacggagcgcacatcttcgttcagaatgtcgctgatcggggaggggatcaccatgatgagcccggggcggtagcggctccaggcgtcccgtatggcctggcggagcttctcctccccgccgcagatgatgtcccgctcctccagattggaggtcagcacgctgtaaaagggctggtgccgacgccgggcggaatagcggtagtgaaacccacagccccgcgggctgtggaggagcggaagcacctcctgcatttcccccaccgcccccacgctgccggagatcttcccgtttacaccaaaggtgtgcagcaggccggaggggtacattgcggtcatcagatcttcaaaaaaaggctgtcgcatgcgcatttctcctctctgcccggaaaaagcaaaatcgccggccccgcgtattctgacgcggagccggcttgcagacaggcgcaccggcagggccggcggcctgtggagcagctttcaccggaagcgtccccacaaattcagcaagcaggtttcctggcttgcggctcgtcacgtgctgcgccttctcacatgtgaaacatgcaatggcgatctgcagcacgctccccgcttacagtgaccggatcgctcgggagttgcacccgattccctctaaccagacggagtctggccacttgctgaaaacgtatatgaaggaattatagcacagcccggccggaaagaaaaggcccgttcagcctagccggcaaaaaagtctcgctttacaaaattcgtccagaggtgctataatagcaccacaatccgggctatggaaggcgcggagaagtactcataaaatagaattaggacaaaggtcgtgcgcagaaacatcgcacttttagtgcgaagagctgtatcaaatggctctccagtgagaatctggaactgtactcagcaaccgtgtgaccaacgaaacagcattttgccactggggcatcccactgccttgggaaggcgctgaattaggtagcgccatatggaaacggcggatgggtcgagtcgggatattgcgcatggtctgtttgccgtttccgtacctctgagagatgggatggacgcaggttgctgtagactgttatcgctgacaaatactctgctcccatgtccagggggcagagtatttttatgcctgcgcccaggtatccttggaagtacgactgaaatgttgtcagccgcagcttgcggtggacatagagtatcgcatctgaacaggaaaggaaggaacacatatgaaacaagggaaatgggtgtctctgctgatgactttcgtaatgaccatcagcttggcgtcctgcggggcgccatcggcccagaccacactcccaccggagacctccgcgcctgtggagaccgggcagccagtagagggaaattatcctgttactgtgcaggtttacgacgaaaacggcacgctctacgccgaaacctttgaaaaagcaccggaacgggtcgtgtgcaatcagcctcaggcaatccagcttctgttagcactgggactgggagaccggattgtgggggcctgtagaagtgttggagatgtcaatgagaagtaccgggacgagttcgaggccctgccattcattgcagacaatgatagtccctccaaggaagtggttctggatgcaaagccggatctaatcattggctgggggagcacgtttactgaggataccctcggcagtgtgcaggactggaacgagcggggaatcgccacttacatcgtagataacagcgcctccggcgtagaggggcggcgcacggtgtcacgcctctacaacgacattgagaagctgggggaaattttcggaattgaagataaggcccaggcaatgatctccgatatgaagacgcgggagcaggctattgccgacaaagtgtccacattggaggatacggacaaggtaaccgttcttaccgttcagatggtctatgaaaatgaattctttgggcgtaaggatacggattttacgtatgacctcattgagaaggcaggtggcatctgcctggacgaggcttttggaaagcagagcatcgaaaacctgattgcactgaacccggatgtccttgtgattattaaccggaccgactctcccgcacaggaaaaaatcgatgcgctcaagagtaatccatccctcagcgaagttaacgccgtcaaaaatgaccgttttgtttcgctggattacgtcgacttctatggcggtaactatgaaaccatcgatgcgatcgaatccctggcatgtggtttttacccggaactcttctctgaatgaccgaaaggagtagtaacatgaaaacgagactgacagcgctgttgctggcgctgagcatgatgctcggcctggtttcctgcggcgggcagcctgtaggagaagaaacttctcctgcaacttcccaaactccggttgaatccaacggcgtagaggcagacaaccactatccggtcacggtggagacctatgatcagaacggcgaaatcgtggaacagacttttgaagcctgccctgagcgggttgtcagcatctctcaggccaacaccgaactgctgattgcattgggcctgacggataaaattgtggcgactgcccaccgcttcagccctgtttatgaacggatggctgatgagtacaactccattccctttattgcggagtccggctatccctcaaaagaggttgtgctggatcagaagccagatttgattgtaggctgggggtctctctttgcagaggatgcgcttggtgcagttagcgactggcatgaacgaggagtgcatacctacctgatgaacaacaccgtcagtgggcttggcaatcgcaccgtagatttcctttacgatgatatcgagaagcttggccagatttttgatatcgaagataaggcccaagccatgattcaggatatgaaggaccgaattgctgacatccaggagaaggtatccactatcccggagtccgagcgtgttcaagttgtcaccgtacagtatgtctatgagaatgagttcctgggccgggggggtacggacttcaataccaatctgaccgagttggccggtggtattcaggccaacgataatggacagcagagcatggaggtcctgttgagtttggaccccgatgtcctggtcatactggatctctcctcctcacctgcccaggaaaaaatcgatgcgatcaaggccaatccggtcctccagagccttcaggctgttcagaatgatcgctttgtggtgctggatcatgcagctttctattgcggagggccccgcactatagaggcaattgaaacattggccgaggggttttatcccgaactttttacagaataactctcagaattgcatttgccatcccatagggctgtagatgcagaggctggttcgggcggcccacacgcagagggtgggccgcccgaaccgttccaagcaaacgccgaaccgcggaaaaaggggaatgaatatgaccaaggtaaagccatctattgcaaataccagcctaaatgccggccgccgacgctttccattgaccctatgggtcgtggtactgctggtcctgttgctattatccgtcctgagttccattacgttcggccctgtggatatcgccattcctgatgtggcgcgcattctggtctgccgtattttccggagtgagcccgcccagtatgccggactcctccagagtacaaccgcagatatcatttggaatatccggtttccacgcgtcttgatggcaatggtggtgggggcaggtctgtctgtctctggtgtggtgatgcaggcggtagtccgcaatccactggcggatccttatgtattggggctttcctccggcgcttcactgggtgccacactggcgatcctcctgggggctttctcctggtttgggaattatggtgtgtccgtgggtgcgttcctgggctccctggtcaccgcgctatttgtctttaccgtggcgttttccggaaaatccaagggaaacaccattaaactgttgttagccggtatggctgtcagtgcgatctgctccgcctttaccaattttgttatctatacggcgagcgatgccgaaggtatccgctctgtcacgttctggacaatggggggaatgacctcggcctcctggaatttgcttggcattccttttgttgtcgtgctgcttggcgtcgcttttttcctcacccaattccgtgtactcaacacgcttctaatcggagacgagtccgccctgaccctcggcattcaggtggcaaccatccgaaaggtctatctggtattttcctccgcaatcaccggtgttgcagtagctgtatcaggaacaatcggctttgttgggctgattatcccccatgttgtgcgtatgcttgtaggttccgatcaccgcagggtattggtgttatcaacgatagtcggatctatttttttgatctggtgtgatgtggcagcccgtatggtgttggggaacgaggagcttcccatcggtattgtcacggccatgattggcggccctttctttgtttggctgatgctgacgaaatcctatggatttggagatgagtaaatggatctggaagtacgaaatctatcggtggcgatcgggggaaagaccattattcatgatgtcagtgcagaggtaaagtccaagcggtttgttggtattgtgggaccaaacggtagcgggaaatccactacgctcaagacgatttaccgagtgctcaagccccattccgggactgtgctgctggatgggaaggctttggaagaagtctccttgaaggaatccgcccgccgcctgggagttatgacacaaatgagtacgctgaactttgactttcgggtagaggaggttgtcctcatgggacgtaccccccacaagaagctgatggagacagacaacgacgaggactatgcattagcctggaaggcgctggagctggttggaatggagggaatggccaaccgcaaattcaacacgctctccggcggcgaacgccagcgggttttgatggcgcgggccctcacccagcagccggaagctttgatcctggatgagcctactaaccatctggatattcaatatcagctccagatcctccgggttgtaaagagcctgggtatcgaggtctttgcggctatgcacgatctcaacttagctatcgactattgtgattacctctatgttatgagccgtggcgcagttgtggccgagggaacaccggaaaccattttggaaccggatctgatccggacagtttttggggtggaatccgtcttggtagatgtccctgagcttaaacgaaaaacgattgtctttgtctgctgatgcaggccgaacggcatcaagagaagcgagatgacaacagatagggctcttaccttcactaaggtgacattccaatcctgctctgcgctccgtttacatatctgcctgtaggatccttttacggtgtgtcccattaaattacgaagtaaaaacatgcgccataggccctttcgggaatctccatggcgcatgtttttacgttcgacttcacttaaagccgctcagctcgataaatatcctccgctttggccgccatcaggcgggcggccatgtcgcgtttcattccggcaagcgcacgctcctccgcctccgtgcgccccttcttgcgggccagttgaatgaattcctcccgcacgtagccggggcggagcgtgactgcgacggaacgcccgcggtagctcaaccggaagtaatagcgcccgccgggactctccagctcgttcgccgcctcggggagctccttgtccaccacatacctgccgtccgtaaggcagcgggtgactagctcaaaggcatcccgcgcccccggccctggaaaagccgtcacgaacgagatctccctgcgctccagcaggttcccgtcgtccagcagcggaaacgccctctgcatgaccttaaatccgtgggccacgccacccgggaaaccggggccgtgatagttcagcatctcatcgaatcggaaggagagaagcttcccctcctccaaaacctcgatcgactccatcttaccctcctattcatccgatttcaagcggccggggatacagacttttctccccacccgctccacataggttaagtagaggtcgctgcggtagagcgcacgaagccgctcctccgtcataacctcctctgcattgccgaccagaaaacggccgtcattccccagaataccaacctgcccgcccagcagaagcacatggtcgggattgtggctggtcataatgacgccgaagccccgcttcaccaaggcgcgcaccatggagagtgcccggagctgattgccgtaatccagatggttggtgggctcgtccagcaggatcagctccggctgctgaacgattacccgggcgatggttacctgctggcgttccccgccgctgagctccgtatagggccggttggccagcgggagcaggcccatctcctccagcgtggcgtccaccaggtcatagtccgcacgtccaggctgctggaaggttcccaggtgaggggcccggcccatgactacaaaatcccgtactgtataatcataagcgggggtgtggctctggggaacatagccgatgattctggaaatctcccgcagttccagccgagagagaggcgtcccgtggagacggatttccccctgctgagggagcagcagatttgcaatacagttgaggagggtagacttgcccgctccgtttgcccccagaatagagagaacctgtccctgctcaaaggcgaagctcacgtcataaaacagggggcgttccggccggtaggcgaaggacagatgttctacttccagaatcatgacagcttcatcctttgtttcaacaggagatagaaataaaaaggggccccgataagtccggtcaggatgctcaatgggagctccgcgctggtgagcacccgagccagggtatcaatcagcagaaggaacgcagcccccagtaccgcggatagggggatcagcttgcggttgtccggccccaccatcatccgcccaaaatgggggattaccagcccgatccagccgatcgttccgctggtgcagacggcacaggcggtgagcatcgtggcacagaaaatgatgatcccacgggcacgccgaatatccatgccaagcgacttggcctcattctcgcccagagagaggatgttgatccgccaccgcatcagcaggagaattatgattgcagccaaaatcggtggtcccatggtgaacacatcccgccacactgcagtcgccaggctgccaagctgccagtgcgtgatggaggcgagctgcgtctccgggtcggccagatatttcagcaggcccagaatagcgttcatcagcccgctgataatcacgcctgccagcaccagggtcatcatggattgattcttgatgacctttgggatggcgatggccagcagcacggcagccaggccgcccaggagcgctccggcctgaattcccactccgccggcgttcatcaggattccaaccgaggcacccacacaggcgccagccgaaacgcccagcatgtcgggcgccaccagggggtttttaaagaccccctggtaggccgctccagagagggagagggcgctccccaccagcagggcagccagtatgcggggcagacgcagggtaaaaatgacgctctccgcctgtccctcccaggtggccgggatgggcaggaatctggagaggagcacccgcaccacggtcgccggggagatggcatagcgccctactccgatggccaggatggtcaggatgagcagcgcggccagacatcccagaaacagaaccggaaaggagcagggccggcggggtgtttgctccagggccggggctgggttactggctgtccgcattggcatcggcggcaaagatctgggccaggtcttcatccgtcaggctgtagccgaaatagtcctggaaaaaggccctggtgtcctgctcgatatcgatctcggcaaaaatttccggctgaatcagttgggccagccagcgcatcatcaacggagtctccacgcccggggcgtcccagcggtagatacccatgggggtcttatagacgcggtgattgagtacggcggatacctggctccagtcctgtccatccagcctgttctcgtacagatccgccggtgtaaaggagtcgaaattgctcatcagaatgatatcagggtcaatggccaggatctcctccatggtgatgctggacagatcggcggccacattgtctgcacctgccagctccagggcctccgcgataaacatgtcgttgccctgcagcttcagctcggcattgcgcagatagagcaccttgggcttgtccgcggcattcacctgctcctggaaggactgcagatattcatacgcctcggtataaagtgtgttgaactgctcggcccgctcctccttgcccaacatctgaccaatggcggtaaagctggcctggagatcctcgatggtctcgttcttcaccataaccggcgtgatgcccagcgccttgagctgttccgcttcctcgggctgatagtcccagatcaccacagcctggacgcctcggctgaccatttcctccatgttgatggagaagtcggagccgatgctggtggtgtccagctccgcataaccgctgtccagcttggagaaaaaacagttggtataggcggtcatggcgccggggttgatggagaccatgtgctcagaggtgccgtcgatggcatagatcacggaggaccagggcagcggggtaaccgcgatgcggctgagctccgccggaacctccaccacgttgcccgccgcatccgtcacggtgcgggtttccgccacagcctgctccgtctgctgtgcgggggattccggtacaacagacggggtctccgcggtgatcccccctccacaggcagtcagcagggaggccagaagcgcgccggacacggcggccgccccgaggcggtgtaaatgtcgtttcataagtaccattcctttcctgttccaatttaaattctctgtccagggggcctgaggccagggcggacgtcccggtcctgctccccggcaaaaataaacaccttctcctgtatctgaacaagagaaggtgttccaaaagaagcgtaccgcaaaaagcgcagagcaacccgcggcaccctcatctaatggctcgttagataccaggtgtcccggagcatttaagtatcctgactcgacttctccgcatcaccccgacttcccaagcctgtcggctcagtgtcattgtgggggatgctccatctcacagtggcggcaccgtaccggactttcaccggtttccatgaaatgctccaatgccttttctatattgaactttgtgattacagtatagcacgtcggccgccatccggcaaccaccgggagaagtgcatttttccattaccaggtatgactttttccaatagccgacatcacacacgccacatcctccagccaccgtgcgggcagtccacccctgccgcacactccgggctctggacaggccagaagctccgcccgtggaaaccacggccgcagggaggggaaaaagaggggatctgccagcaggacatcgggcgtcgcccaagcggccagctccgccggatcgccaaacagaagcgtatctgcggtgagaaagggccggtaaagctcctttaaagtccggtagggggcatagaaggcgcggaggatccggcaattcggatattccccccggatcgcccaggccagtccttccgttgcaatgggcgctccgatcaggagaagggtgcggttccctgtttcatgttccaccggcttctctggcggggccccctttgccgccgtggagaaacgggacagccatcgctccagtccatagcgttccagcggcaggccgcagaaataggggattccatagtcggcctccatttgccgtgccgcccccaatccttcggccgtcaccacccagttcagggccggcgcagaccggagctctccgcccccaaaaccttcctccccccagacacagacctgatacccccgggtggtcaaagcctccgccccgaggcgcagcggctgtctggagcccagcgcgagatcggaatagcccagaatagagatcctctggttgtcacgcccctccgggcgcctccaagtggccagattccgcagggcccggtccacgcccactggtgcggactcaaatccggtgcaggggaacctgagtaccgggaccccccgctcggccagactctcctgtatcccggtatagtccatgccgagcagttcgggaattgcactccccataaggccgcagaaagcgcggccgctgtgcgcaaagcctctcgcaattccgttgactgccgctgcctcgcagcccgcggccagctccagatcatcaaaccgtgaatgttccagacgcagtccggcggtggcgtcgtcccccagtgtcagacatccggtgcatcctccggcagtcaacagaaaggggtaggcgtcccagctctggagaagggacgccactccgctgaaatccggcggcagaacgggcagcggcgcgctgccccggggaatttcccccacaggcgggggaaaggtggacagaatttgctccaactctgccacggcattccgggtgcgggccaccagaggcccccgcagcagaatccggacgggaaggccagcctgctccgcaacctgttccagatcgcattgcgtcagcacctcggcacaggaggcgtagagcacgaccccgcctacgccggggcggcgtgcggcctcccgaagcctggctgccagatgctccgctgcccggccggcggcgtagtccgccctcgtcagcgggcagggcaggaattggtggagtttccccagctctgccgcgcgcaggtaaagcgcccgcacacaggccagagaaccggcagccgccagaagaaggtctcccctttgccaaatgcgttccggaagggtcataaagtgcttcccgcccccctccgccgaatagacttccacacggcaggcgtcacgcaagcccctccacctcctgttctgctgcccggcggcagaatgcctccagtgcctcgtcccccagtggccgggggctggtgggctgggtatcccagagccgctgggccagttccagaaagcgcatggccgccgccccgtccggttccagatggtgtacggtggtatgcagataatccgctcttcggagctggcggtcttccggcaggataccgacgactctggtcccggattgctctgcgaaggagcgtaccaaggcatcctctcccgctccgtggctgcggttttggatcagcccgcccaacaggggagcggcgccggaatagcgggcgactccgcgcatgatgttgttggcggcgtagagcgccatgaaatcggcagaggtgatcaggtatacccggtctacaaaatgttttcgcatgggcactgcgaaccctccgcataccacatcgcccaggacatcgtacaccaccacgtcccagggctcctccagaatgccgagccggttgagctcgtccgccatggcggtgatgcccaggccggcgcaccccgcgccggcctggggacctcctgcctccacacaggagacgccgaacgccccgggaaagacaagctgctcccgggctagaagctcctccgacctccccagagtctccagcacagttgggattcgtcccgacgtcaggcagcgggtagagtccgccttggggtcacagccgatgtgaagcacccgtttccccgttcgggcaaaggccgcggagagatgggcggccacggtggacttcccgatcccaccttttccgtaaaacgcaatacgcaacatcttgactttctgcgcctcccttgcatgttgtctgtaatttttaattatatcacagcggagacatcttccactatttccattttcccttattgaatattggtttttccgatagcagatctgcccgtgcctgcggcttccctgggggatctgcttgacttccgtgggaaagattgctatgataatatccacaataaaatattgtttttcgtcaagtgtccgctttgtttgtgcgtttcagcggagaaaagggaatcgggtggaagtcccgagcgatccggtcactgtgaacagggagcactttcacatatgccattgtgtaaattacacgagaaggcgtgtcagtgcggcgatctgtgagccaggaaacctgcttgatgaagtatgttgatgcttccggtcaaggcctctcgacacaaatgggacaggtgatttccgctggaaacccggaaacgctgtttgtgcgaagcggacctttaatggtctgctttttttcctcttatggggtctgactctggaagacggccgtggaaccggcacattttctgcatccgcaggacttgcgcgtttccagatataagttggaccgaaagaaggaggattctatgaatctgaaaaaacgcctgactgctgcgctgctgagcgcggcacttgccctgtctctggtggcctgcggcagccccgccacccaagagagcccctcaactgccccctcccccagcgcggaacccgcatccgccggtcacaccgcagacgatatgatcgttttggctggtgcccgtactctggcccctggtctggaggatgtctatttctcccacaagctcctgggtgcatgggaaccgctgatctccgtggatgagagcggaaaccccatgggggtgctggctgagagctgggagcgcaacgaagacgccactgtttggacgttccaccttcggcagggcgttaagttccagaatggagaggacttcaacgctgatatcgtggtggagaacttcaaccgttacaagctcatggagagcggctattcccagtatactacattcaaggtggacgagctctaccccggcctcattggctgtgagaaggtcgacgactacaccgtcaatgtcagctttaccgaccccatcccccggctgttatttaacatgaaggacactgcaagctgtattttctaccccggctcctgggacacggaaaccgggtacttcactgagcagcctgtcggcactggcccctatattatcaaggatatcaaagaggatgagtacgttgatatcactgcttttgacggctactggggagagcccgccaaaacaaagaatatccgcgtgcgcatcatcactgaccctcaggcccgctatgccgccttggacagcgaggaggtcatgggggtgctggacctcggggctatgcctgccgccctgggggacgagcttctcaaggatgaccgctttgccatggcggtgcagacctccaatattacccatataatgcttcttaagggtgagggcaccaaattttccgacatgcgtttgcgtcaggcggtaagtctggccattgaccgtcagcttattgtggaccagctctggggcggctatgccatgccaacgcagaacctgattaaccgtatgtgccccgactgggtagaactgcccgtagagtatgatatggacaaggccaaggagctggcccgtgaggtgctgggggacgagcgccttccgttggatatgtatacccgctctctgtatctggaccgcggcccttacaaggagatgatggagtatatccagtcccagctttcccagatcggtatcgatgccaccgtgaatgtgattgactcctctacttactctgagatgtccaaggccggtgaacttggggcaaacttcatgactcatggtatgtccaacctcaatgcctaccacttcctggatatctatatgagcagcgaagggtcttacaataaatcccagcatttggcctacagcaacccccacgtggacgagctgctggccgagatgaagaccaccctggacgacgaccgtttccatgagttggccgtggagctccaggagattgccaacactgagttgcctgttattcctctgttctacgacaccagcaacctcatctacaatcaggagcagattacaggctacgaggatttcagtgaccatttggatctgagtcatctttcctgggtgaacgcgcagtaaccgccacaccgcgccaaagctgtgctttggcgcggtgtttttcaagggaggaatttcattgaatcaaaccctgcgctataccgcaaaaataatattgtggacaattcccattctggtcggcatcacctttctggccttcggtctggggctggttgcacggggagaccccgctaccaatcgggccagcgccgatcccaactatatccccactgaggaggaaatccaggagctccgggcggaaatggggttagatgatcccattttggtgcaatacgggcgctggatctggaacgcagcccacggtgatctaggggaatcctatattgacgacaagccggtgctgggtgagattctccggctgctgcccaacaccctcctgctgagcggaatggcgttgctggtcattactgtggtggggcttgctggcggcctgctgcttacactgttccgggacaaattcattgacctgctcgggcgagttttactggtgtttctgatgtctattcctggtttctgcctagcctattttatgatctggctgttcgcccaaaagctgcgtatcttgcccaccagcggcgcggagacactgtcctgcttcctcatgccctgtcttgctatttccatcggctcggcctgtgtggttatccggctgcttcgctcttccattctgggggagcttagcaagaattacattctgaccgcccaggccaagggcctgcggaggggccagctcatttcccgtcatgcactgcgaaattctctagttccctccattacttatatcgccaataccttcggcggtcttctgggaggctccatgatcacggagagcgtattttccgtcccaggaatcggaagctacgccctcaccgccatcaataatcgggactatatcgccatacagggctatgtgctttttaccggtgttgtctttgttctggtctgcctgctggccgacctgatctgcgcctggctgaacccgcagattcgattggggggctgagcatgcgtggtaaaaaagtcttgttcatcctttcactaactgtgcttgttcttttcctgctggtaggggtctttgctgattttctggcaccctgcgaccccaacgcggtggatatggccaacggccttgccgccccctccactgaacactggctgggtaccgaccatatcggccgtgatctgctgagccggcttatctacggcagccgctcttctgtgttcatcgctttcttcgccaccggatgcactctgttgctgggcatgactatcggcctggtgtccggttatctggggggatggatagatcaactgattcaggctgtggtcaatatcttccaaggaatccccagcgccgcttttgtggtcgccatcctgggactgctgggccccggtatgcgcagtctgctgatcgccattgtggtcagctcctgggctggattctcccgtattgtgcgcaatcaagttctggagatccgcgagctgcactatatcgagggcgcacgggccatgggcggcgggagcttctatatcatgcggcgccatatcctgcccaatatcttgctccctctgctggttctaatcgccacacggatcggctctacggtgctcaccgtggccgccatgagttacctgggcctgggcctgcgggcacccgcagcggactgggggatcatgattaacgatgccaagctctactatgtgaaggattttcttgtcctactggcccctgcggcctgcctgactctgttctgcctgagcatcaacttgattgctgattatctccgggactgccttgaccacgatgacggcgcggcccgcatgctgtaaagggaggacgcacatggaactgtatacaaaggacctctgcgtcctctttgctacccattcgggtgatattcccgccgtcaaccatgtctccctcgcattttcggagcggcaggtcaccggcatcattggagagacgggcagcggcaagtctgtgctgggcctgtctattctcggactgcttcagtccaacgcctctgtcaccggacagatctttttgggagagcgggagctcactgccctgtccgagcgggagctgtgcacagtccgcggcagagagattgctctggtggctcagaacccggccacctcattgaatcccagcgtgcgggtgggacgccagatcgaggaggtcttccgtctggctggaaaaagtaccccagactgccggagactcacgctggagcttctcaggcagatggccttttccgacccggagcagattgcaggtgcctaccccttcgagctctccggtggcatgcgccagcgtgtactgacagctatcgctgtggctgcacgtccgcaatggctgatcgcagatgagcccaccaagggactggatgcagtggtgcgcaatcaggtttacgacaccttctgtatggtacgggaccagtaccgcgtcggcttcatcgtcattacccacgaccttctgctggcccgcaaattctgcgagcgtatcgttgtcatgtactgcggccgtgtcctggagaccaacgcggcgcgggaactgtttgagcaccctaggcacccctatacccaggggcttatcgcctcgctgccccacctgggcatgaagcctatggcgggcttttctcccgcctttaccgaccagccctccggctgcgtattccatccccggtgcccttacgcggaggctcgttgccggcatacagagccgaaatccatcccctgtggagaagggagcgtgtgttgccatcgctacgattgaagtccagcacctctcaaaaagttttcactccaatcgccttcgcggacgcacccacaaggcggtggacgatgtttccctcgccatcgggcccggacaaacttatgggctgatgggggagtccggttgtggcaaatccactttgggtcggatgattacccggcttctcccggcctcctccgggacagttctctatgacgggacggacctcttggacattcctcagcgaaagatgctcccctaccgccggcgcattcagatgctttttcagcacccggacacttcgctaaatccgcggatgacagtgctggacagtctgcgggagccctttctgctccacgatctgcccggcaagcaggatatggatgaaataattcgcgcccatatcgagccctatggcattcagccggagctgctggagcgccgggcctcccaagtcagcggcggccagatccagcgcattgtgctggcacgcatcatgctgctccagcctgagtttattgtactggatgagcccacttctatgctggatgtgtcggtacaggcccagatcatggatctgctacaccaggttcagctccgaaccggagtatcgtatcttctcatctcccacgacctcgatctgctgcgccacgcgagcagccggattggcatcatgtaccggggaaagctgctggaacaaggggagacagaggccgtactgaatgcccctacccacccctatacccgggaactgattgagaacttttcctatatgagggattaaacgcccattgggaggtgacctctgtgacgcttcaaaatctaaaatatgtggttgcagtggcggagtacggttcgttttctgcggccgccaaggccctttacatctctcagtccaccctgtcctccgcaatcaaggagctggaggccgagcttggaactcaactcttcctgcggagtaaccgcggtatccagcccacccccgacggggaggacttcctgcgctatgcccgcgaaattgtggagcagagccgcgccctggaacggcgttatcgccaccggagatatgcgcctacacggttcgcggtttcgacccagcggcttccctttgccgtccgggcattccagagatttatggagcagctctcctggaacagctatgatatcgccatccgggagtgcccaacctataccattattagtgacgtggctgctggaaaaagtgatgtgggggtggtggccctgcacgaccagtacattccagcactggaaaagacctttgagataaaccatgtgactttcaccgagttagaacgcttgccaacgtatgccttcctgcgtagaagtcaccctcttgcgaagcgggacaaggtcagcatggccgaactgctccaataccccttcgtaacctatgaccaggaggcggatcgctctgaatacaccgaagaagttgtgttccatcagattgcggaaaagaccgttcacgtctccgaccggtgcagcaaggtggcgctggttcggtttaccgatgcgttcagcataggtccggacctgaccaacagcaacgccgatgccttccacagcgggatgggtgagattgttgccatgccggtagaggagatctccgactcactccatgtcggatatctgctgcaaaagaatgtggcggtctcagccgccatggcagtgtttctggactatctgcgggacgatattatagtgttaaagaagactctttagtaacgttagattcgtttttattgaagtgtccggcacaggatccacggaagactgtataaaaaatgcgccgtccggcttgagccggatggcgcacgtttcttttgttagtgtaaaattatcgtaggcaaaagaaaaagggaaacggtgaaaacatcgcttcccttggggctccaaagtcagtagaattgtgagttgagaacaaacacctactgcaaaggagtcccaaggtaatggtaacaaagttagagacacaaggcaagcagatttttcagtggggcgagaagtttgtagacatcgccacactggagaaagcggtgtacgaagccgttctctccctcggccgcaatatcatgcgccagtgcatagaggaggcggatcggacgctcgctcggcagcgggaccgtgggatgtaccgggacaagggctaccggcccaccacgctcaaaacagtgatgggcgaggtggggtaccagcgccatgtctacctgctgtccggggccgcggagcagcccagggcaacggtatacctgctggacaggagcatgggccttgacacggtaggccttttcagcgatactgtgtgtatgatggcggtggaagcggcctgtgcggtgagtcaccggacggcagccgccacactcaacgatctgaccgggctgagcctgagccacgagagcgtctggcgcattgtccagaacgctgggagctgggagcaagcccgagtggacagcctggcggcggcggcaaaggccgagtgtgggtctgggacctatgaaacgccggtactgtatgaggagatggacggcgtgtaccttgctctgcaagggaaagaccggctggaacacggccccagcaaagagatgaaggtgtctattgcctactccgggatttacgaggacgccagcgggcggcgaagccttgccaacaaggtttcatacgccagcatggaacaggcggaacacttccgccgccacgccgagggtgtagtggccgacttctatgctgtggactgcgtgaagcgacgggtctttaacagcgacggcggaacctggctgcaacggaatatggtgcctggatgtacctaccagctcgatttgttccaccggaaccgggctgtgcgtacctgtgtgaatgacccagacctccaggaaaccatcctggagctatttcatgcacgtaaagtcaaagaagcgattgctgtggtggaggcatctattgagagcacactggatcccgacgaacaagagaagcggcggaagctgtttacctacttcaacaactaccggaaatcccttattccatactaccaacggagtggaagaaaacccccgctgcccaacgagggccagcagcccgcccggtgtgggagcatggagagcaacatctttaccattattgggaaccggatgaagcacaaccgcacctgctggagcgtggccggggccaacaaccttgcggctttgctcgccttgcaccgcaccggccatctgcggcgtgttctgcgggattggacggcccacggggccccctctaagctatacacaataacggctcccatatctgcaaagcaaaccaacaaacagatgagtgaaatctatatcccaccgcatttactgtctgctggtgacctccatccagccgcgaagtattgcctgaccaaattcttcccgctgtccgagatgcacaccacagaatgactgtgctggctgagtgcgcttggcccggtttacgccgaggccattcaccttgaacaacactttctactggctccaattttggtaccagcaccccttgccaacgattttgttacacatactttcttttgttccatcttgacattccgagtgcaccctgataaaataaaaaaacaagtgaatatagttggtacacaggtgtccatccaattgtggtgggtgaaaagggaagccgggtgagaatcccgcacaaagccgttgctgtgttggcggagtgcctctctgctatgtcactgggatgtttgttccgggaagacggagaggtgcgtttgaacgtctgagtcagaagacctgcctgtgtataacgcacaaaaaagcctccccggacctgggagggtgcagtttcaaccacagtaggaacctgtggaatttgttgctgtatccttcaggatacagtttttttgttgccgaattcacttgtccctcctatttcgtgctgctccacacgggacacgggactcttctgcaggtctcgcgtcattttggagcaatcggctggaagaaaagggcgcataatatcgtgggtaatattatgtgttcttccagccggaacaagagaagcacatggcctgaacccggcgcaggggtgggccatgtgctttttattataccgcagcgctcggcgaaaaggcgattatcaggatcgcgaaatagtgtttggaaaattttcatgtttaccccttgcattttaagcggaaagttgtataatgaactcaaaagaaagccatttgtaaagtgcaagtttaacaaaagatagttctttgaaggggatggcttctgagttctgcatgggcagagtggcatgcaccttcctgtaaaatttaatatgaatccggcttttgtggcaaatgcgcgacccgactcccgtcagggagcggacacgcatccttgtttctgaacaagggaatcaggtgaaattcctggacatgttttgcagcaggagccgtggcgaaagctacggggacgtgcaattcaatagctgtgattgtggagtatatctgttttctgcgaaagcaggtcactggcggtcgtaatggcttagctgggaaggcggcggatatgcgcaggcgggctttaagcccgtcgggacacattagtcagaagacctactaggagcttacccccaattcattggggttgctctgagataaatgccaaatgtgaggagggcactgaataagtggccccttctacccgaaatgggagcagaagcggacgcatattttgcgtccgttttttattcgcaagctcgggagaaagacggacgtatcggtatgcgtccgtctttttgtttcgattgccccaagaggtttgcggggtagccggattgtgccacaagtcaggaggctgttttgtgaacggtaagcatttcatcggcaaccagcagctcagcagaaagctcattgggcggaccaaggaggcgcttcgtcagcgaaacgtccagtttgcccaggcgcatggtgacgccagcgacgaagcgctgctggattatgtccggagcgaggcggcgcgctttggcggctggcagaatgtgatcacgtcagcaggactgccctcgccgaagaagcagaagcccacctccaagcggcagattttcaaggaggagttccgttgccaggcggagagcgggagtgcacagagcaacagaacagcagcgagcaatccggaggaagaaggggatccccttcttccgtcatagggaaacccctatgacggaagaaggggatccccttcttccgtcatagggaaacccctatgacgatctctctttgagcattcagcgggctatcgcctgtcgcatatggccggtacgcggctgacaattgaataacccagtaccaaaagcgatattccgtgagcggagtaggccaggacgtcggcaaggccggccgagccaccaacagcggagagacgtggagcaatgcggggcggcaactgcacaggaacagtattggtgtttgggcggagaggatcagcgggaacgggacaatcggtgcggcggcccctgcgctttttccgggagcgcggcggcggccgcattgacggttgattaaaatgcgacttctcagcggaaggaggcggtgagagtcaaaaagagttgtaaacaggagtacaagggaaacgatccaacggagagacttgaaggaggtttacgtatgaaaaccagaaaatttacagcgatgctgctgaccctggctatggcattcagcttgctgacggtcagtgcgggagcggtaatggacaatgaccatgaccgcatcagcgttgatactgcaggccctttgtcggtggtatgggatagtgaaaccgtagattccgaagcttatcacacaggagatatcgtgtcgagtgaagacggctactatccctccagcttctacctctatgtagacagcgccgaggagaacggaatcaccgttactggcggcaccctgtctgcgcctgtggaggaaacggagggcggcaccaagtatttggtgaccaacaacagcgggggcagcattgtgattaggctggcgaatgcggcccagagcaacaacgtctacacgctgacctttgctgcgccggagggacagatggccggcggcgccatcaccggagtcttgcaggggtatctgccgctgggccagtatgcccggggcacgatgtggggcagcccttataccgacggcagcacgacggccggcagcacccccaaggttctaggcgggttctcttctaccggcgtctccttgggtgccggcggcggctacgtccagtatgccctgcgggacagcgaagggaaccaggcctatattgaagatgacgcgagcaatccctatggcgtggactttatcgtctacggcaacgccttcaacggcaaccctgaggcggcctctgtccaggtctccgaagatggaaagacctggtatgagctggccggaagtttgtactatgaccccaatacgcttcgcgatgtgaacatcacctataccctgagcgggagcgatattcagtacagcatcacggatccgaacgggcgcaatcccggcgtttccttcccactcaccgggacgttcaaggctggcgccgctgcgtggttccccaccacggcgaactacggcggcgtgtggaagacgtccgccgtctccagcgatcagaccgtcggcgcttccgcctttaacggcgccagcgtgacttataccggcgttacactggtaaaggacacggataccaccgcggactatcagtttggctatgcggatatccatgtgaatggcggcaattatggtacggcgatcaatccctacaccgccgcggccaccacgcagggtggggatggcttcgacattgcgtgggcggtaaagccggacggcacacctgcggggcttataaggatcggttatatccgggtatatacatccgcactgatgagcagcacggataacaccaccatccccacacccggtatcttcggtgagacctccgctgaggtttgcggcatctacgcggtgacagggagcggctctgccagcatcacggaggatctgtttattgccgatgcagcgacaggagagaacgaggtgaatacgagcaacggggggagccaggtagtggccgctggcaagtaccgtctgtactccgatatggagcgtgtgttgctcaatggcgagacgattagcgatgctgcggatgggcatgtgtttacaatggcagccggagacatgttacagatcatcacgcagaccggagaagaggccccgtatattactgtgctgatttgccaataaaaaatggatatggataaaataggaaaagtgagcgagcgtccttttggacgctcgctcatctcatttattttgattttgacaatcctgcttgggtttttaccgacaactgcttttgccgccgagaccatgaccgtatcggacccagatgctttggagcaaattggaactataacaattgaaggaaatgattataatttataccgccttgtagtagatactgtgcaatataatgcgattgagttttcggatgcgtcaagctgcgcaattacgactgtcgtgccagttatgggtaagaaaccagcagctataggtgcgacaaacttgattaacgtggcacctgattcggaaaattactcgaaaggtgaggccctttatcaaagcagtatttcatccaatctgtctgaagaaattttagatggactaagaacagacacagacaagcttggatactacctatatactgttaaacggggtaaaattaataccataattggtgtccttattttggaatggccagaggcatcgcaagaagtcgaaggagcaaataaagatgagcttcaacgtgtcattgctagggctggcttaataagtagtagtgattactatcaggctgaggattattacaacgggaagacaacgagcagtgacggcttttggcaggactttcagacggcactaaaaacagcaaaggagattttagataatataactgcaacacaggaggatgtgaatggtgccacagcttcattgaatgcggccatcgccaacctgatccctgctaaccaggtcaacgccactgtcctgtatgaagccatccaggaggtggaaagccgagggtaccggcaggaggactatacgccggagacctggactgcgtataagacagtctatgagaagggcaaagcttacctcgcttccctctatgaccaggatgggaaccccacaacggagaacaaggctgagcatcaggacactgtggagcagtacgcggaggagttgctggctgccgccggcgatctggacgctgtttacaacggcggcgatgaggtgaccagcgcgtcgatctatcagcggtcgcttgccggtatgctcgctcagttcgcgggcgctttggaacatgagagcggctatacagaggagagctttaccgcgttccagacggcctaccaggaagcccaatcctactatcagcagcacggtctggtagggacgtcggtgtccgcgtctgtcctgaatggatatcagagacatgcggcggcgctgtggtcggcctactacgaggggctggagagcgcgaaggaaacaatttctgtctccctccgcgtggccgacagccaggttgcctacgacctcgccagcccagacggagcggagctgggactcccgccctcggaaggcatctatgagaaccctgacgtctccctgagcggtgcgggccgcaccgttgccggactggtcgcgtcagccgggctccagctgcaggtgaaaggcaattcctcgctcacgtcaaaccgccaaaccacggtcgcggtcttcgtcaacggcattcagctccgggatgccggattaaatccgacacagctcgacggagtggccgtaaatcgagcgaagtggggcgacataaagctccgggacggcgatgaagttgtgatcctgttcgcccccgctcccatggacagggaatacagcgccatgggcgtaacggcgtatgtcaacacgacagacttctggggcctgctgtcgtttgaagaccatgcggagaccgtggcagagggcgaggcgcttacgctgaaggtgacccgaactggaggctgggtgggaagctacgacggccgctctgcgccgttcaacggcgcccgcctgctggcagtgaagctggatgagagaggagcgccgtccggggagtaccagcttctggaggggatcaccgacgcaagcgggacggtgaccacgcatctcaatgaggcgggccaatatgtgctggttgcggcgaatccggaatccgtgatatttgaccagacggccagcggcgcccagcaccagtacgcatcgctgaacgcgcccgcccggaccacagtgacggtcacccctctgaatgaggaagaacttgcggcggcgaaggaagcgcgcaagagccttctggctgcggtgctggccggatgcaacgccactgagttgggagaagccgtctacgcccaggtccaggcggcccatgatgcgggagtgcaggccatcgaggacgcgacaagccttaaagcggccgaagacgcgctctcaaatgcgctgacccaaatcgagagcctggtggagaacgcggagaaatccaatgaggaatctgtctctgccatgcggaaatacctggcgaagctcccaacagtggcacagatcggggagggactcttcctgcagagcgacatctccaccatgcaggaggcgagttcccactatgccggaatgaccggctaccagaaatcacagctcaccggccaggaacaggcacagtgggaggctctggtagaagcctatggtgaggacggaagcaacctgccggaaaagacctttacgctgacctttgagttcattgggcaggagggatccagtgacccattcaagagctttttggcccttaaaaacaaaggctttcgatatgcgaacgtcattgaactctcgcccaatgatgagtggtgggtatatatccgtacggaaaccggcactgcattgaatgaactggactatgagatctatcgtgtggagtccacgggggcgacactgagcgaattgaggctggataggcccccaaccgatccgaaaggcggatacaacaagggttgggaaggggttgcccctttctacttcgctgactccacatcagcgttcatgccgaggaacgatgtgacgatcacattttatatccgaggcaaaacatcggtggaaagtctgcgcagcagtgcgctggatcaactgtcagaggcgttcaatggctataagcggtctgattacagcgatacaaactggaagacactgacatctgcgtatgacgagggcgtgtccaagatcaatgcggcggagaacgccgaagcaatagaaacagccttgagcgatgccctcaatgcgatgaaagccgttgagacgcgcgtttccagcggagagttcggcagtgtgcatgtgaccgttgagaacaccacttacgcggacggctctttctatcaaaatggcggcgcctttgtagaggcggaggtcgagctttacagtgataccactatgatgactgctgtgttggaagccctgtccgagaacggttatggttggaacaacgggaatgacacgagcgtcacttacatcgaaaacatctataaagatgtaaatcagaatgggcagtgggacaatggcgaagccaaacttgcggcatttgacggcagtgtgagttccggctggatgggcgtgctcaacgattggttcaccaactacggattttcttcctatgctgtttcaaatacggatcgcgattaccgcctggttgacggagacgagatccgcgtgatgttcacgatggacgggtacggagacgatctgggcggaacctggggcaacggagacaccagcctcaaggaactagaggtcaccggcggtacgctgtcgccatccttcgacggggagaccaccagttatgccctgaccctggacggcggagatgtgtcggtcacacctacagcggcaaacaaaaatttcctggtcaagacatttatcaataacaaaaccacggccaacaatgtggagtactatcgccgtggtgaaaatctaccggtccagccaggagacaccatttacatcggtgtgggcgaatacaagtggccgtccatgaacaaccagtccggcaacacgctccgctataccggcacctggtacaccatccaggtctgcgagagcggagcgaagggaatccaggccaggatcgacgacctgccggataagtcagaaatcacatatagcaactataaaagcttccaacagacggtcagtgcgctacaagcggattataatgcactgccggacaaatcacaggtttctgctgctaaactgacagcagcggcggagcagatccagttctttgcggctattgacagcgtaaaaactcagatcgccgaccttcccactgccgtagaaattacggagaatcctgaggcgcaccgttcaaaagttgaagctgcaaaaacggcttacgaggcattgggtatcagcggccaactttatctgaaggcagcggaggtcgcccgtctcaacgaggcggtggaggccctgggcgggagcatatcgccggacgacgtggccgcagtacaggcgtttaacgatctggtggaagcgattggggaaaaagtcagcgccgggagcaaggatgccattgtagccgccaggacggcatatgagaacctgacggatgcgcaaaaagccctggttgcaaccgcgccggattcctacaacatcctcctcaatgcggaggccgccctgcctgtggtagaacggatcgccggaatcggcacggttacgctggagagcgaggcggccatcaccgctgcccggcaggcgtacacggactatgccggcaagttcagcggcaaggacatggtgtccaacctgaacgtgttggaggctgccgaggccgcgctggagatcctccagggcggcggacagggcacctccggctaccgggaggtcatgaacggcgttctggaatatttggagcagaacgtcaaaaatccgattgtcggctccacaaaaggcgagtgggccgtcctggcccaggcccgggccggcaccctgtccgaagacgtccgggcggcatatctggccaacctggcggattatgtggagacccatgacggcatactggacacctccaagaatggaaccatgcacacagagtacgcccgtgtcgtagtaaccctaaccgctttgggcatggacgccacacagttccaggtcagtgacggtaaaacctacaatctggtgaagccgttgctggacgaggccgccgaaggcagcagctacacctatcaggtctctgagcagggcaacaacggcaccatctgggctctcattgccttgaattccggcgattattaccgggatgaagcgggcaacacggcccgggccgcatggattgacctgctgattgacaagcagcagtccaacggcaactggcccatctataacccggaccaggagaatgacggctccggaagccaactgggcggcgtggacgtctgcgccatggcactccaggcgctggcaccctactatctcgacgcaggtgagttcaaccgtctgggcacagcgcacagccatgaagatctgcagagcgctgtaaaaaaagctttggatttcctgtccacctcgcagaacagcaccggcggatacggcagttcggagtccagcgcgcaggtcattgtggccctagctgcgctcaagaaggatgcggggagctttgccaagggcagcatcagcgttctggcggacctgctgggctaccggaagacggatggcggattcagccacacctctgatggtcccatcgaccaaatgtccaccgagcaggcagcctatgccctggtggcttacgaccgctacaagaacaacaagaaacccctctatgacatgagcgacgtgtttgacggtccgacggacggtactgataccgaccacaccatccacgcctcggcagatgccggtggcaccatctctcccgtcggtgatgtcacggtgccggatggggcgaagcagtcctttaccgtcacgccaaacgagggctaccagattgaggacatcctcgtggacgggaaatccgtctgggccggcggtgcaaccgtggcgcagaaactagaaccgcccgaataccagctacccacagttcccgttgaggacgtggagccggaggcctgcgccgacggcatccatgtgggtgagaacgtcgtcatcggccagcgagcggccacctgcacagagcctggatacactggagatacgatctgcggtgcctgcggcgaagtgctggagcagggcgcggaaaccagaacggttccgcatcagtacggcggcgcgtggcagatggacgagacgagccattggcaggtgtgccagatctgcggcgccaaaagtagcgcagaaccccatgtgttcgagcagacggaggagcccgctccaccggagctggagttcccggagcagggaggcgccactcagaaacccactaccggcgaggaaaccgaagcgcccggggccgaaccggagatgcccgatgccgacggacaacagccggaggagaccgaggggcaagatcccgacacaattcctccagaaggagaatccgatcctgaagtacctgcccccggagaggaaaccggagaagactctgccaacgaaaacgagcccccggcagaggagcagaccaaaattccggaatccgccgaagccccggccagcgatgagagccagccggatataaaccccggcagcacgggcggggaactggtcagtgttgtgggaatccacccgatgctcctgatgagcgtgggcgccggtctgccccagacggacgggacagcggagccccatgcagaggggagcgcctgccaggtgtgcggctacagcccggagacgggcggcacggcggcgtgcagccacagcggcggcacagccacctgcacggccctggcgagctgcgacctctgcggccagtcctatggcgattacgcacagcacgccttcacagagacagcccacagcagcggggtgcactggaacgtatgcgccgcctgcggcctggaggagctgtcctctctggccccccacagctgggagctggacgcggcggcctccacggagacaatttccgtctatgtgtgcccggactgcggcgcggagcggacggaggcggaatctgccgccccgaccacagccgccaacgccctggtcaccagcgcggacagcaaatcctacacctacacctttgagaacgtcaccgaggaccacgccatatccgtcacctttgagaagccctcccctgtgatcgtgcaggaggtgacaataaatggcaatactcagaccgcggtcatcgacgaagcggcggtgcagaaagcggtagaagcggtgactgcatcagcggcggataccatcaccatcattcccacggcggacagcagcagcatttcctcggtcagcgtggaactgcccgcgggcgcggcccagaccatctcggaggccaatgccggtgtggagatccagacgtccaggggaaccgtcaccctccccgcaaatgtcctgggctccattgcccaaaaagagactgacggggagaagctgtccatccatgtggaggagaagagtcacagcgcaatggaggacatagttcccgatgggacgaacctcgccggtagcgtggcggtggaagtgtcggtcagggtgggcagcacagaacttacctctttcggtggtcacgaccttaccctcaccatccccgtggacaacagctttaccctgagtagagagtacaaagtgctggttatcagcgataacggtagccatgagattcttaccggcacatgccgcgtttctgacagtggccgggtggtcagcatcagcgtgaaccacctgagcaccttcatcgtcctggcagagaccacagcgcagacctttaccatcacggcgacggctggcggcaatggagatattgatccgtttggctctgtcgaagtggatgccggcgaagatcagatcttccacatcacgccggacaacggttacgagatcgccactctgcgcgtagacggaaagacggtcgatctggacgagctgtacatccgttcggacggcagcgcttcctataccttctacgatgtggatgcgagccacagcatccgcgccaccttccagcgtggcacggagatcccggactttggccccgtggtaggcgaggtgtatatcagcattgagaataacacctactggggcggagacttcaccggcaccctggcgtctggctggtatgacttgtgcgccgaggacaccatgatgaccatcgtactcaaggccctggccctggacggctactcctggtggggtaccggggccagcgataccggaggctatgatatcacctacctgtccggcatctatatggataaaaatggaaatggccggcgggacaacagcgagcccagcttggccgagttcgacggttcccggggtgccggctggatgggcaccctcaacgactggtttgtcaacgaaggtttccagtccttccgggtcggaggccgcggcacctacgagctggcagacggcgactacctgaacatcgtgttcacccagaacctgggcgaagatgtggggagtctctggggcaattcggacactagtctggaggacctgcacattagcggcgggaccctcgccccccgttttgacggcgataccttggagtataccctgagcattaccgggaacagtgcgcgggtcaccgtgacgcccaccgcggtcaacaagaactacatggttaagaccttcctgaaccgctacaaccgcgactctgccttctacaagcgcacggagagcatcacagtcaagcccggcgacatcctttacatcggcgtaggcgacccatcgtggccttctatgaacaaccagagcacggaggccattgactacgagggtaccaagtataccattaccgtggtgaacggcaacagcgcggaagcggtcattgggatgatcaaggcagtgccggagattacctatgccaactacaagacccaggcatctaaggtgtcggcggcgcgggcggcctatgacgcgctgacccaaaaggcgaaggctgagatcagccagaccctcttgaataagctggaggccgccgaggagaaaatcgagttctatgagaagatcgacgcagccaaaaagctcctaaaggagctgccggcggttaacaagaacaaagtcccgaccagtagcctgatccgtcaggtgcggaaagccgcagacgcatatgagaagctgaacagcaagcagcgggagtacattacagcagaggacgcagggcggtatgaggccctgcggctgtggctgatagagtccggtgcggtcgggcagaatgagctgcctgtcattgacggtagcctgacactgccagagcaggacggcgttgaagttgtcctggagcccaaagcgtctgtggataatagcggaaacgcttctgcggcggtgactgcggcggatctcaacaagctcctggacgaggctctcgaggccgaggccagcgtgctggtcatcgtcccgacgggggcggaacaggcgtccgctatctctgtggaattgccccgatgcaccctggacaacgcccttgacgagacgaacgcggatctggctgtacggacgccgctgggcgagctgtccatgccaaatctcacccttgccagaatcctgagtggggcaggcgggcaggatctgaccgtcaatatggcacggcgcaccatctcccaggcagaggctctgctgaacggcagggcggacgttacggaagagcagatgagcggtgcctctgtggtggaggtgtcccttacctccggcaacaagtccatcaccagctttggcggccggtccattaccctgcttctgcccgtgaatgccggtgcattccaggcgggccaggcctgcaccgtataccagatcagcggaggcggcgcggtagagaagttggctggcgtctgcctgagccggaacggcgggctttgggtaaaggtcagcacgacccaattgggcacctttgttgcagtaccgccggaacagccggtgcagctccccttcacagacgtgcgtgagggagactggttctacgacgcagtggcctatgcctataccaacgagctctttaacggcaccagcgccaccaccttctctcccaacggcaccatgacccgcgccatgctggttacggcgctgtggcgtctggagggcgagcctgcggcggctggcacatccggtttcccggatgtgaagccggatgcgtggtacaccgaggctgtggattgggccagccagactgatatcgtcagcggcacaggtgcgggctttgacccggagggcagcgtgacccgtgagcagattgcctccatcctgtatcgctatgcgaagctcaagggctgggatgtaagcaaaacggccaatctgcaggattttgccgacggtacggatacctccgcttgggcaacccgggctatggagtgggcctatgcggagaagctgattaccggaaaggatggaaagtgtttagacccgcagggccaggccagccgcgctgaggttgccaccattttgatgcgccttctggagagtaaggcaaagaacgcctgagatgccggaagaaactatgaaacccccgttcggctccggtctgtaaacccaggccgagccgcatgggtgctccccctatccacccagtaaggatggagggagcaccttcttacttgagcaggagcccggcagaccgaatttggtctgccgggcggcccagcccacaattaaacagagatgcagtcaggtgaaactccggaaaaccggtacgggcctgcccccgccgtctagtcggcaagacctgattgtgaagaaatgggtgggatatacaaatgtaaggcacgctcacccaaggggagggcgtgccttttacttgttgaggtgagcggtatcatgctcaaagagcaaaagctgacggaaaaagagctgcggggataccgccagtggctctcagaactggacgtggaaagccgggaagaacaagaaagttcaagacaaacggtggatccggacatctggcgggtatttaatcccgaagggaatatcggccggcagatttatgagagctatacggatgaggcgcttttggaggccgtggttgggacaatggatcatccaggccataagccacggctgtatcagctcagcctaatacgtcaggtttatttgaaacggcgctttggaagtaccaataaagcgtgctgggcagccaaaggatttcgaaaaaggctggaagagcaaaagcggtggccgccagactggccggagcgggtgtccgcagacagattcagggcgtattgcgaacggattggttctcccttgacggagcgggagtcagaactggtagaacgcatgtgcaagtctgtcaaagaaagctggcggccgccgggagaagaagaaatcacaccagagcttaagaagctgtttcaaaaaaagcgatgtaccaataaaagggccatggagctgatgggcatacctgtccttagcaagctggccatgaagcatttgtggagctattggctcagtgcctggagggaacctgcagggccttccgaaagaaaaacaggaggagacgcggtcatatgaagaaatggaaacagcgtggattcgcatttgtgcttgccctgtccctgaccacgggtatgttgacgggagcgcaggcggccgtatccaaagagaccttgaacgaggcggtgcaggataccgcagaatatatgtaccgcaccgtacagaacccgcaggtagggtctatcggcggtgaatgggctgtgctggggctggcccgaagtgggtacgatgtaccggacagctattatcaggactactatgccactgtggaggcctatgtaacggcctgcgacggcaagctgcacgataagaaatatacggagtattcccgtgtgatagttgctctcagctcaatcgggaaagatgccagaaatgtggctggatatgacctgaccaaaccgctgggcgactacgaaaaaacgatttggcaggggcttaacggcccaatttgggcgttgattgcactggatagcgcaggctatcccatgccggagaacccggaggcaaatgtacaggcgacccgtcaaatgtatatcgaccgcattttggagtgccagctgcccgatggagggtggagcctgttcggaggaacagaggcagccagttctggcgatggaatatccgatccagacatcaccggtatggctctgcaggcactggccaagtatcaagatcagccggaggtagcgcgggctactaaggaagcactgacgtgcatgtcggaacagcagagcgacgatggcggttttgcgtcctgggggacggctaactccgagagttgtgtgcagatgatcgtggctctgtgtgagctgggcattgaactggatgatcctcggtttgtaaagaacggaaacaccatgctggacaatttgatgaccttctaccggcagggggagggcttcctgcacacccagtccggctccgggtccaaccagatggcgacggagcagggcttctacggcctggtggccgcccagcgggcggcggaggggcgcagcagcctctaccgcatgtccgacgccctctccatccccgacgccgtggagacagagatgagcgggcagggacagggcttggagggcaaggatcccgccgtgaccgcccagcctatcacgtcaccgggcaagaccttcccggacatcgccttcagtgaccagatcaccgccatcgaggccttggccgcccgaggcatcattgacggcaagtccgacggaaattttgacccggatggaagcatgacccgggcagagtttgcaaccatcgtggtacgggccctggggctgacaccagcggacaccggcgccttcgtggacgtggcctccactgcctggtattccccctatgtgggcgcggccagcacatacggccttatcaacggcgtgggcgagggccggttcagcccggacgggactatcacccggcaggaggcggccgtcatggtgtcccgcgcggcggagctgtgcggactcgagacggagatggataccgcagctgtgcggaatatgctggcgcagttcccggactatatgagctccgcggagtgggccagggcccggctggccttctgctaccaggaggggatcctgagccaaacggagttgaacgtccggccccaggacgctgtgacccgagcagaggttgctcagatgcttttcaaccttctgagtagcgctgagctgctctgacgattacagaaaggggacgaaacagtatgatgaacgtagcttggttcaagaatccggatcatgtggcttactttaaggaggaggagatacttccaaagctctcccgggagctgggcatcaacgacctggcccagcgggtggaggcgttccggaaggagccctcacctgaaggggaaaatatcaagggccgtaagcgcaccactctcaagctgatgatccccaatctgacattctccgagcccgtcgacatgggagagaacgtgtggatctatatgggcgacctgtgcccggcctactgcctgtacacgccgtgggaagacagtgaggcggccgaatgaagctgacaaaagggaaaatcattgccgctgtggccgtgatcgcggtcctggcaggggcgttctggtatggcggcaacgcgccaggtcttcagggctggacggtgcaggagcaggagagcagcgcagtgctggaggccgcgccgcccgcctccggtccggaggaatccatagcgcctatcgtgacacctggcggggaggcggaaagccccccgccgacggtgagcggtagtccggtgccgtccgagaccccccaggagactgatgcccttgcgccatccccaacacccggtgggctggatgcccgcccgggcggtgcggagggcggcatgactgcccgggagaaggtggaggccgcggccgagctggcgggcggctcctccgccggtgtggaaaagggcgacaaggagtactcagaggccaacggcatggagatcaatccggagactggaaaggacaagtatcttacggatccagtgccggaaggaaagcctctgccggtggagccgcaggatgtggagttctccgatgtgacccatacctgtacgctctctgtccgctgtgacaccattctggacaacatggactggctggatccagagaaggtggagctggtaccggaagacggagtcatattccctacgacgactgttacgttctacgagggggagagtgtgttcaatgtgctccagcgcgagatgcggaaggctggcatccacatggagttcgaggacacccccatgtataactccgcttatattgaggggattaacaacctctatgagtttgactgcggcgagctgtccggctggatgtataaagtgaacgggtggttccccaattatggctgctcacgctatcagctcaaagagggggatgtaatagagtgggtctacacctgcgacctgggtgtggatgtgggcggtttttattcgactggagagtgatctgaaattctttcagagggataatgctcatgccgtatacggtagaggcaaatgcagttgccgttcctgtaagaacctatctgaacgagtgcgtggttgcgggacgattcctgcactactgcagggagtgtggcaactgcaataccgggaaggcaggacgttttctttctcctccaataaggcgtgggaacgctatccctgccgctccatgcggaagggatggaactcagccgcctgttccgctatcgtccgatgtatatgctgggcagagcgtgcggagatgcttcaccatttggagaacggcgttaaggattgcagcaaatgcctgataccgcaccaaagggacaactatggctatcttgctggccgctttcaagagattgccggcgagatagcgaggcatgaacaggagccgcgggcagagtaggccgagtagcgtgcataccgggaatgcctcgcaacagaaatgcacaccgggtacggctgactgccgtacccggtgtttagaggggatgccttatccgaaatagagataccttttccagctatcacccaataataaattttctgtattttggaatggtgatagcctttacaatgtttttcatgcacccggtcagcctcggcatttcccttgggtcggcgctggcctatgcggtctatctgagagggcggaaggcgatacgcttctcgcttgtctttatgctccccatgatggtgatggccgccctgatcaacccggccttcaaccatgagggggcgaccctgcttacatacctgccatcgggaaatccgctcacattggagagtatcctgtatggattagcggcggcagccatgctggccgcagtggtgacatggttttcctgttacacagcggtaatgacctcggacaaatttgtctacctgtttggaaggctcataccggccctctcgctggtgctgagcatggcactgcggtttgtcccaaagttccaggcccagttccacgttgtgtcggaggcgcagcgatgcatcggacgggatgtctccgatggtggggttatccggcggattcgaaacgctgtcacgattttctccatcatgcttacctggagcctggaaaatgcaattgagacagctgacagcatgaagagccgggggtatgggcttcctgggcggacggccttctccatttaccgctttgatgaccgggacaagatggcgctgggatggctgctctattgcgggttcttcctttgctgcggagcggcgctgggcggctttgcctggagatactacccgacggccaagggagcgcctgcggcgccgctgacagcctgcctacaggcggtctatttggcattatgcctgacgccggtgttcctgaatatccacgcggaccgtacctggagcagactggatgcccaaaatgaggtgaagccatgtaccaaatgatgagcctgcctctgtactccgggacttttcaggagtacgacagctggcgtgatttaggccaggaactggaacggctgggctgcgacggcatcgaaggcgtctggggcggagaggatctgccaaaggatttgcctgccgagcttattcttgggtaccacctgattttttacccggactggctggacttctatcgggatgaccgggcggcactgaaacaaaaattcggctcactggaggccgtggccagcttctatggcggtctggggccggatacgctgctggagcaataccgcgcggatttacggcgggcggtgaacctgggcgcccgttatgtggtcttccatgtgtcggacgtatcgctggaggagggatatacctaccgctggctgcccaccaaccaggaggtcattgacgcggcggtagaggtggtgaacctcattcttggcgaggagagatggccgtttgaattcctggtggaaaatcagtggtggccaggctttacctttacggaaccggaggagacggcccggctgctggagggaatccgctttgcggggaaagggattctgctggacaccggacatctgatgaatgcttgtactgagttgaaaactgaggcagagggagcagactacatccggagtatgctgaaccggcatggcagtctggcaaagtgggtgcggggcgttcatctgcaccagtccctgagcggggcctatgtgaaggcccacaccggttcactgccggcggggctgccggaggactatatggagcggtttggagtgagctatcagcacatcctccagattgatcagcatcgcccctggacagaccccgccatcctgccagttctggagcagattgaaccgcgttacctgacccacgagctgtcctctcgcgggcgcatggcccgggcggaggccgtgagcatacagacaagactattacggcagggagggcggatgcgtgtctgagcagaagaagccaagtattgaaattgaacacttttccttctattacccggagcaggcggagaagacgctggacgatttaacactgaccgtggagcagggggaattcctggtgctgtgcggcccgtcggggtgtggcaagtccacgcttctgcgacagctcaagacggtgctggcgccccacggccgaaggctgggaagcatccgtttcgaggggtgccctttggaagaactggatcagagggagcagagcgccggaatcggctttgtgcagcaggaccccgaaaaccagattgtcaccgacaaggtgtggcacgaactcgcctttggcctggagagcctggggtatgacacgcctaccatccggcgccgggtggctgagatggcctcctttttcggcattcagacctggttctacaagaacgtcacggagctgtccggcgggcagaagcagctcctgaatttggcgtctatcatggcgatgcagcccagtgtgctcattctggacgaaccgaccagtcagcttgatcccattgcagcggcagactttttggcgacgctggggaaaatcaaccgggagctggggacgacggtcgtgttgacggagcaccggctggaggacgccttcccgttggccagccgtgtggcggtcatggaccgcgggcggctgctctgcacagggagtcccgcggaggtgggggcgatcctgcgcggggcgggacactcaatgttcctggccatgccgaccccgatgcggatctgggcatccgcgccggatgcgggcggacactgcccggtcacggtgcgggagggccgggattggctgacgaagttcgcggatggacaccccctgatggagctgccgtctgagccgcgccgcacatatccgaatgaaccggccatcacggcggaaggtctgtggttcaaatacgaaaaagagctgccggacgtggtgaaggggttgagcctcaccgtgaggcggggcgagtttctggccctgctgggcggcaacggaacgggaaagaccaccagcctgaagctgttgtccggactccagaagccctaccgaggcgaggtgaggctggcggggagcgtgggcgtgttgccgcagaatccccaggcgctttttgtgaagaaaaccgttcgagaggatctctttgagattctcaagggccggaatttctcggggaaggcgcaggaggagcgggtggcctgggcggtgcggctgtgccgcctggagggattactggatcggcacccctatgatctgtccggcggtgaacagcagcgggcggctctggcaaaagtgctcctgctggggccggagatcctgttgatggatgagccgaccaaggggctggatgcagagttcaagcaggtgtttgccgagatcctgcaaagcctcttgcgtcagggtgtgaccctgctcatggtcagccacgacattgagttctgcgcccggtatgcccaccgttgcgctctgttttttgacggctccattgtgacggaagccccaccgcgggcctttttctccggtaatagcttctataccacctcagccaaccgcatggcccgcggcctgcttccggaggcggtaactgcggaggacgtcatacaggcatgcgggggaaatctaccgccggcgccagagcttccggacagcggggagccgctcccggaaccagaggaagccagcgcagactacaagcctaaaccgctgccctggtggcgcaagctgggggcagtgctgacaggaacggtgtctttcctcctgttcctgtcgtttatgaacgttacggatctgacccaactgattactgccgacggcatgacagaactggcaaaccatcaaatgattctatacgcactctttattctctcgctctttctgtttgctacctgtatcacccggagatcccaccgaaaggattatgccttacaggtacccaaggccaagcggaagctggccaagcgaaccgttgtggcggctgtactagtgctgctgatgatccctctgaccctgtatatcggtgtgttttatctggacaataagaagtattactttatctctctactggttctgctggagtgtatgctcccctttttcctgatttttgagggccggaagccgcaggccagggaactggtgatcatagcggttctgtgtgccattggaattgcagggcgggcggcgcttttcatgctgccgcagttcaagccggtgatggcggtgaccattatcgccggcgtggctttcggtggtgaaactggcttcctggtgggtgcaatgaccatgctggcctccaacgtgctcttcgggcaggggccactgaccccctggcagatgttttccatggggatcatcggcttcctggcaggcatcctgttccgaaaggggctgctgcggcgcaaccggggtgcactatgcgtgtttggcgcactggccgccatactgatctacggcggaattatgaatccggcatccgccctcacctgggtgggagagctcaatgaaaaggtcctgctgacctactacatctccggactccccttcgactgtatccaggcggctgccacttggctttttctctggtttggggcggagcccatgctggagaagctggaccgcgtaaaggtcaagtatggagtggtggagagatagtagttcaacggcaaagatcttttgcataaccgtttgacgggaatttatttacaggcaggagctgcccatgttggaacggccatatggctcttccgacatgggcagttttctttgtattccaaacgagcctgtcatattgcataaaagaatggcttttaatctggcataatgccgaaattgcattatcagatcataaaaatttttaaaccggaaattggtcttccgctttaacctttatacttctaatcacagggcaagacgaggcggtgagagagatgaccccgtcagagcggagaagcgaaattctgcatctgctatgcaaaaggcgccatgagaccgccataaatctctcggcagaacttggcgtttccgagcggacaatccgtgcagacctggtgattctctcgtgctactatccaatccaagttgtgcgtggacgttttggtggagggatccatttgccagactggtttcacatggagagccgcacactatcctctaagcaacaagtattattgatgaaggttcgtaaaaccttgtctggagatgatcttcaggtcatgaacagcatcctggcacagtttgccctgtattgggagtatcggtgatctaccgatttccgtcctgatccttgcaaatagaatatccggcagcgggatacgtccactgatgagagcccctctgtaaggagggctaaagcgacgctggaggatgcgccaagaccacctgtgcggaccgtgagcccgcatcaaagacggccaaggaaggtgcagagcggtgcccatacgtccacaaagcagcctgtggcgggctgtttcgcattgcggctggtttacccggcccgaccctcgtcagcaatctgataatgatactcctgtccagccacagccccgggtgataccgggatcaagcaatgggggcagctcggagagatcctcggaggggtgagattcccgtgatgcgcgccagcgcagtccgtctgctgccgccctgacacctgggggagtagtgtcgaatacaggtgcggaatgattgcctttggaaatccaaaataggaagcggaggccgctccctgcctattgggggtggcctccctctgaaacgagggttggttatgaaccagaatatcaattatatcgggctgataattctccttcgccaccttcagagcgccggccttgttagtcggaaggaggccgggaggatcgccgcccggctccgtgtagagaccggggcggacgtcatattttccccctgatttttgttgcgtttggatatggatattttgtggcggtgctggtattgtgtgttgctgacaggaggcaatttcgtggacgagcaaaagaaaaccagtggttccctggcattgaacagcacgccccgggtaatcaccatcgcgcccagcaccccggtcagggatcgcaagctgcgtgtggcggcctacgccagggtgagctccagatcagaggatcagctcaactcctttgccgcccagaacgcccactacacggagctcatcaccgacaacccggagtgggagtttgtggacgtgtatgcggacaagggtatcaccggcacctcggcggaaaagcgggacgacttccaacggctgctggcggactgccggcggggtcgggtggacaagatcctggtgaagtcctcctcccggttcgcccggaacgccaaggagtgcctggagaccgtccgggaactgaaggccctaggggtgggggtatgcttcgaggagcagggcatcgacacctcagagttggccggtgagtttcttaccgccatcttcgccatgatggaccagaaggagagcgaaaacatctcagacaacctccggtggagcatcgacatgaggatgagggcgggaaagtacaacacctgcaccgcacccttcggataccgcctggtcaaagggaagctggagctgatccccgagcaggtgccaatcatccggtatatctacgaagcgtacctgtccggtaagacggcgggggatatcgcagcggcgctgaacctgttctctaaaggaaaactctggaagccacagcggattgactacatcctcaccaatgagcggtacagcggcaacgcctttctgcggaaacggtatacgacggataccctgccacgcaaaataaagtataaccatggccaaaagcccatgtactttgtggaagggattaacgaggcagcgatttcccaagaggtgtttaataaagcacaggaattgcgtcggaggcgcggggacagccaggtgcccggaatcgcaggccaacgtccccttgccaatggctggctatattgtggctgctgtgggaaggcgcttcgccctaaatgtataaacaggaaatggtacatggcatgtcgtgggcatgaagaatccacggagttgtgcgacctcctgcccattgctgaggaagcggtagtatcagcagtgttccacctgtactataagctccgtcaccagggagtgcctatcctcacccaactgctcgcagatctccagaacgcccggaagggtaagctgctctggagcctggacatcgtggcactcaaccagaaaattgcagacatcacccgtcaggatcgactgttggcccagctcaagcagcaagggcttgttggccctgacatttttatatcccgccaaaacgagctggcggaacaactccgcgccgcgaagctggaaaaggaacggttcctggaggccgaggaagatcagacgatccagcagacccaggagttgatcgaagccctggaggccgggccggacttcctggacgcctttgatggggagttgttccgcgagctcgtggacaagattatcgtggagagcaatgatcgcctgcggttccggttggtcaacagcctggagctgacagagcccatagaaaggacgatgcggtgatggggagcaaccggaagcggcccttcggctacaaaatggagctaggcgaaatcgtgctccacccggcagaggcggcgacggtgcgctggctctacgacagctacctggccggtgccagctacaatgccttggtagacaagctccgggagagaggcatctcctatgacggggacaagccctggaacaagaacatggcagcccgtatcctagcggaccgccggtacaccggcgaaggtggattcccgtccatcatcccggaggcccggttcaacatggttcaggctcaaaggcaagaaaaattctccccctgcaaaaagacgccggcccagaaggagctgcggaaactgtgcggcggcagcccaccggcctgggtggagcggcaggtgttgggcctcctgaaccgcctgacccagcatccggagcgtatcacctgtccggccccggtggctggatcgccgccggagacagagaatctgcgccgggagctggacgagctcctgcaccgcccgccggtggacgagacacaggtcaaatgcttggccttccagttggccgccctccagttaaacgccatcgggccggaggagtatgaaaccctaggcctccggatgctgttccaggagcgggctcccatggtggagttggagcaggaactgctccatgagagcgtccgccgcatcactgtcagcaacgggacggttaccgtcctgctgaaaaataaccagaccttggaaggaggaaatggtatatgaataataccgcacccaacgtcaccgtcatcccagccaaagtggagacgccccaggaacaggagaagaagcgccacctgcgggtagcggcctactgccgggtgtccacggacagcgaggagcagctctccagctatgaaaaccagctttcctactataccgagaagatcatgaaggaaccgggctggaccatggccggggtgttcgccgacgagggcatcaccggcacctccacctgcaagcggaaggagttcctgcggatgatccgccagtgcaggcaggggaagatcgacatgatcctggctaaatccgtctcccgcttcgcccgcaacaccgtggacaccctcaacttcacccgggagctgcggagcctgggtatcccagtggtcttcgaggagcagaacatcaactccatctacccggagagcgagtttctgatcaccctgcacggggctttcgcccaggccgagagcgagagcaccagtagccgggtgcgctggggcaagcgtcaggccatgaaatccggccatgtcgccatgcagtacaagcagctgctgggctatgagaagggccccgacggcaagccaaggattgtgccggagcaggcggagaccgtccgcttcatctatgaccgctacttggccggggacagcatccgggagatcaaagtggccctggagggccagagaattcccacggtctccggaaaagtagagtggatgggctcccatatccggagcatcctgaccaacgagaaatactgcggggacgtcctgctccagaagaccttcatccaggactgcatcagcaagaaggtgatccccaacaccggacagctccccaaatacctgattcaaaaccaccatgagggcatcgtcagccgggagatcttcgacgccgtccagctggagatggcccggcggaacgccaaggcgggtgccacgcgaaagagcacccccaccggccgggggaagtacagcggtaagcatgtcctcagcaacctgctgttctgcggggagtgcgggacggcctaccggcggtgcgtgtggacccagcgcggagtcaagcgccccgtatggcggtgtgtcagccgcctggactacgggaagaagttctgcacccagtctcccaccctggacgaggaaccgctccagcaggccatcctggccgccgtcaacgccgtcatgctggatcgcgacaccctggcccggcagctcaccgccgtcatggagtgggagcttgctccgatgttgggtgagagtatgagcctggcggacattgacagggccctggaggaactgagcagccagttcaacagcctgctggccgaggcgtcagccaacccagcagaggactacacggagcggttccgggagctgtccgagtccaccacccgtctcaaagaacggaaggcacagctggagggggcctgccaggaacagggtcggctccagaaccgcctgcgggcggtctcggccgccatggagcatatgacggcggcgatgacagagtgggacgaggaggtcatccaccagctgctggagaaggtgacggtgctctcccgggagaagatccgggtgaccttccgggatggccgggagatcgagcagtatgtggcacagccaaaaaggaggaagcttgcatgaagatcttcgctataggtgataccctctggaattttgagcggtttcgcccggaatacttcccggagggccaagagctcaccaaggaggatgtggtgctccagctgggagacttcggcggcgtgtggttcggagatgaacgggatgacgaggcgctggactggctgaaagggctgcccttcacggtggccttcgtctcgggaaaccatgaaaactacgatgcccttgtgaaatacccgatagagaactggcacggcggcagggtgcagcccatccggccccacgtgctccacctgatgcgggggcaggtatttgagctggccggccgcaccttcttcaccatgggcggggcggcctcccacgacattgaggacggcatcctcagcctggaagatcccaactttgagcgaaaatacctgacattgaagcggaaagagcacgcccgattccgcatcgatcacctgtcctagtggagggaggagttaccctcggaggaggaatatgcagaggccagacgaaacctggacgcccacggctgggcggtggactacatcctcactcactgcgcccccaccagcattgctctccagttctcccggcacaatgtggcggaccacctgacggacttcctccaggaggtcaaagaccgggtgcaataccactactggctgttcgggcactaccacggaaacaaagccattgataccaagcacatcctcttgtgggagcaaatcgtgcagattttatagagaaggccgtaagggaaagggcggcgttttgatccgccgccttttcctttgcggccttctgtccaagaaaatatctcaccactatggagtagatagaacgaatgtgctataattggcttgaaaaactccggggaggcggtacgatggcgatcgaggacggcgcgtggatcatgcgggggctggactgggatgaccccagccgcacccagagctgggaggagctcatcggcttgattgacgaggtgggcttcctgcccctgttcaaaaacgaggtagacagcttctccgcggaggagaacacctccgacctctattggtggacgggggacgaggaacaggattcctgggagtggcggcggctgatcgcccgcagcggcagggtggcctacggcaagttcttcggcggcaaggcgggcttcatctccagagcatggtttccccacttcgccaactggcggagggacggctacgacttcgacagccgctgggacgaggagctggccaccatgcggcagaagcggatcatggaccagttcctgaccaaagacgagtggttctcctttgaactcaagcggcaggccggattcggcaagggcggggagaagaacttcgagggcacggtgactgacctgcagatgggcggctatctgctcatccgggatttccgccggcgggtcaacaagaagggcttcccctacagctggcacatctccgtctactccaccccggagaccctgtggggctatgaccacgtctcatccgcctactctgtagctccggcggagtccaaggccctgattgatgaacagatctggaggaatttccccgaggccacacaggaagaattggacgccgtgctgggttgaacccgataattggacagcgcccgtgatatactaagatggaaaggagatgaccggggcgtgaaggaaaagtgctacctttgctgcgatttgaagagcttttacgcctcggtggagtgtgtggagcgggggctggatcccatgaccaccaacctggtagtggcggacaagcggcggacggacaagaccatctgtctggccgtaaccccttccctgaaggcctacggcatttcaggccgggccaggctcttcgaggtggtgcagaaggtcaaagaggtcaacctccggcggcagcggcaggccccgggccggcggttcaccggcgcctcttggcacgaccggtcggtgcaggagaacccgtctctggctctggactacctggtggccccgcccagaatggcccactatatcgactggagcacaaagatttacagggtctacctgaaatacattgcgccggaggacatcttcccctacagcatcgacgaggtgttcatggacgtgaccaactacctggatacctacaagatgacggcccgggagctgacccagaccattctactggatattctgaacaccaccggcattaccgctgcggcgggaatggggagcaacctgtatctggccaagattgccatggatatcgtgtccaagcatatccgggccgaccggcacggcgtccgcatcgccaagctcacggaggagagctaccgccgcctgctctgggcgcaccggcctctgacggacttctggcgggtgggcaagggctacgcgggcaggctggaggccaacggcctgtacaccatgggggacatcgcccggtgctccattggcaagcctacagattaccacaatgaggagctgctctacaagctgttcggggtcaacgcggagattttgatcgaccacgcctggggctgggagccctgcaccatcgcggacgtgaaggcgtacaagccggagaacaagagcatcgtctccggccaggtgctccagtacccctatgactttgacaaggcccgtctggtggtgcgggagatggcggacgccctggccttggagctggtggacaagggcctggtgaccaaccagcttgtgctcaccgtgggctatgaccgggagaacctggacgacccgggccgccgtcagaactaccacggcccggtagccactgaccgctacgggcggagcatccccaagcacgccgtgggtacggagaatttcccatacacctcgtccgccaatgacttgcagaaagcggcggcggccctctacgatcggattgcggacaaaaacctgctgatccgccgcttaagcatcagcgccaacaagctgctggatgaggcggaggcccccaatgggcacgaggcggagcagatggatctgttcaccgactactccgccagggaacaacaggaacaggcggacgaggctgcccatgcccgggagcggaagctccaggaggccatgctgggcatcaagaagcggtacggcaagaacgccatcctcaaggggatgaacctggaggatggcgccacggccaaagagcgcaaccaaacgatcggagggcatcaggcatgagtgggccatacgacgacatcataaacctcccgcatcccacctccaagcggcacccccggatgcccatccgtgaccgggccgcgattttcagccccttcgccgccctgagcggccacggggccgccattgccgagaccgcccggctgacggagcagaagatagagttggatgaggacaccaaggcagagttggaccggaggcaggccgtgctgctggagtacatggacgaacggccggagctcaccgtcacctggttccagcgggacgaaaagaaggacggcggggcttacctgaccaccaccggccgactgaaaaagctcagagaactggagcggagcctggttttgacagacgggacagagattccactggaagatgtggtgactctggagagcgacatcttccaaacacttatgtagttgaccacaaaagggagcacggtgcatcagacgccgtgctcccttttgcgatcaaagcaggcgcggggcgccagaaaggagagctcaatgaacgtcagaaagccaaccgattacagcgccatgtatgggatgctggatcagctcatgggggcggagttcccgcagatggagctgtactttgagatcggcaagatcgtctgtgcccacccggagaagggcacggcggtcatggccgccgagtatctccaggcaaactaccctggggatagaggattctccccgcgaaacctgcggcggatgcgggaattttaccgcgcctatgccgacaattcagagctgagggcgctggccctgaagctgggctggacacaaaatatggccatcctagaaggctgtgagagctttgacgagcgcacctggtatctccgggccgctctggggcaccactggacaaaggtggagctgctggaacagatccaagccggagcatggctgcgggaagaactcgacgaaccggacaatacctgttatactgagagcaacatagtatcagtggggtgtctggagcatgaagaagatcctttttgtgtgtcatggcaatatttgtcggagcccgatggccgagtatgtgatgaagaacttggtgaaaaaggcgggactggaggaccggttccagatcgcctcggaggccaccagccgggaggagatcggcaacccggtctacccgcctgcccggcggaagctggcggaacacggtatctcctgcagcggccatgccgcccggcagctccgcaacagcgactacgaggaatacgacctgctcattgggatggacagggcaaacctccgcagcatgtaccgcatctgcggcggcgacttcaacgacaagatgcacctgctgatggaatacgccggccgcctggagcaggaggtagcggacccctggtacaccgaggatttcgatgccacctggcgggatgtgctggcgggctgccaagggctgctggatcagatcattgcacaaggagtgtgagcgcatggcgtcaaagaagcctatgaaagatcatattcatgccaaagggacagatattgccgtcgtttccagcggcgatgagaacgactacatctccctgacagatattgcacgctataagagcgacgccccggatgatgtgatcaagaattggatgcggaaccgggacacaattgaatttctggggttatgggagcagctcaacaatccggaatttaaacccgtcgaattcgacgggtttaggatccaggctgggtctaacacgtttaccatgtctccgaaaaagtgggttgacgcgaccagcgcaatcgggatcttttctaaagctgggagatatggcggtacatttgcgcacagggatattgctttcgagtttgcctcctggatttctgctgagttcaagctatacatcatcaaggactaccagcggctaaaggcggatgaaaacagccggcttgcccttggctggaatctcaaccggacactggccaaaatcaattatcggatccataccgatgcgatcaaggatatgctgatccctccggacatcaccccacaacgtcagagctttacttatgccagcgaggctgatgtcctgaatgtagccctgttcggcatcaccgcaaaagaatggaggcaggcacaccctgacagcccaggcaacatccgcgatgaggcaagccttcaccagttgattgttctggcaaacctggagagcattaatgcagagctgatccggcagggcgttccccaaagtgagcgcttgctgcggctcaacgccagtgcaatacaaatgatgaaatccctggtgggagaccacaggattgaaatgctggagggtcagccagatgcaggatatggacaagatcattgacgagctgactttaatgcttttgtatctgacttcttggcaggaatgccctaccgaagagattcggcataaaccgatccgaacggccgagaagctccgcctgacctggaagggccacgaccgcagcgcgctgagccggttggatgcggcggggctggtacttaatgactgtggaaaagctcctatacgaattagccaagacggggaggcgcgtgcgcgagatttgctccggcagtatggcatttcctgtgcggacgcttccaccacccagatggaggaacactgatgagcagtaaacgggtctgccccaattgtggccggaagatgaagcaacagtttatcggtctgttccactgcaaatgcggactcagttggaaaagagatatcggcttttttgaacggactccaaatatggtgtttgcattggaaagaatacaggcaggcaaaaaggtaaaacaggttcctgttatcatatacaaatagccgattgagggagatacttggcagaatcaaaggttgaaaaattgccaagcaaaaatatccagattgaagttgaatgacacaaaaaccgctcttttcgcttgaaaagggcggctttatttttgggggagaaagaaccaccagctatactggtgggcttcccccatatgctttagcaaaaagcagtgatagtgacaagaaagtttcaaatagaagataatatgcccgtttacgggcggccgagcgcaagatgcaggctaaagatagcggtatgggccacttcaccctgtttttaccgcgtggtataggtgcgggtgcgcagggtaaacccggcgtcgtagtgtcccagaatggaaaaacctttttgacatccacgtcattttgcagggctgttgtagcaaaggtgggcctgaggtcgtggaacatgaggtgctctaggcccgtatttttaaaatttacttatagaggtttaccattctgtccgggtgcttttcgtgctcctggatgagcagttccacggcagcctgtgggatggacacctgcccgacggagttctccgttttggagcgggtcagctccagggagcagtcagggttacggacgtattgcctgcgcaccggaattgtccggccttggatgtccacatgtccaaccgcagggccgccagttcaccttttcgcagagcgtcgtccaaatccaaatagaacatgtgcaggagtacccacaccctagcagcctccaagtcgtcccggatgtgctccagaggcaggattttcatgtgcagttttcgggcattagggacgatgcaggcactaacaataagctcgtaatagtttgaaatagcgtagcaaacgttaggctaggcgcaaagcttgtaccacgttcacagtccagtggccggctctcccgatgtccctgataatgacagccatccgccggcagaggtattttcttgcaattctaagtttggagtggtaaactgggcatgcacgcaacacagattggaaggaggatggagcatgaatcccgagagcgacttccggattgagagcacgtatgacaggcaggcgtatcaggccatggcaaaggccacctggaagctgttccagaagcacaggatggaggtgatggcctatcccgccctgatcagcgtggctttggtgatcgccgttctgctggtatttaactggaatcatacggtcctgcccatacgcattttgggtattgcgtttattgttctgcagttcgcggtgatccccctgggcgcgcggcgcgctcaagccaagacgtgccggaaagcgatccgtgatgcggaaaaacggggcgaatatcccgcccgtgtggagtttttgttccaggacgaccatatccgtaccacagtggggaaggaagccacgtcggttcgctaccgggaggtcagccatttggccgctctgaaggactggcggttcctctatttcgggcagggggcgtatatcatccccgtctcggcgtttcgggatgcggcggagctggaccgcttcgatacgtttattaccgggaagtgcggcatgcccattgtaatactggagggggaagtacccaagagctgacggaacgcaagaaggggaggagacggatgcaggagtccgagcgtattttcattgctgaaaacgccacgctgctgcggggaagcgagcgggagctcaaccggcagctctttacgatcctgaacagcatctatgacggactttacattacggacggacaggccaacacgatcctgatcaaccgcgcctatgaggaggtctccggcctgcggcgggaggacgtgctgggcaaaagcatgcaggagattgtcgctaccggcatgattgaccgctccggctccctgggggtgctcaagactcgaaagccggtgacgctggagcagaccttccgcaccggcaaacaggcgctcatcaccagcacaccccactttgacagcagcggggagatcaccatgatcatcacggtggtccgggatatgacggagatctacggcctgcagcggaagtatcaggagagcgaggagcgccgccgctccgaaatggagttcttgcagcgcaaccagaggtttgtctcccgcatggtggcggccgatccccgcacgctggaggtgctggcccgggcccagaaggtggccgccctggacacgacgatcctgctgctgggggagaccggcgtgggcaaggagcagttcgcgcggtacatctacgaaaactccgcccgcgcccggcagagtttcatcggcatcaactgcggcgccatcccggccagcctgatcgagagcgagttgttcggctatgagaagggggccttcaccggggccagcaaagagggaaagatgggtgtgtttgagagcgccgacaagggcaccgtctttctggacgaggtgggcgacctgccccttgagatgcaggtacatctcctccgcgtcctgcaggagatgcaggtgagaagagttggaggcgtacgctccatctcggtggacgtgcgcatcatcgccgccaccaaccggaacctgctggacatggtgcatgaaaagaccttccgggaggatctgtactaccggctcaatgtggtgcccatcgagatcccgcccctgcgggagcgcaagcgggacattcgcccgctggtggagagctttctcaaggacatgaacaagaagtaccgctatcagaagcggtttgccgacgcagccatggagattctatacagctacgtctggcccggcaacgtgcgggagctgaaaaacgtagtggagcaggcggtgatcctcagcgccggggacgagatccagccctccgagctgcccattgcctgccgatttgagggggagagccacggcggggacgagactggccgtgtgaacctgaagctggaggtggcgcggttcgagtacgagtacatctgccgcgcctatgagaagtacgggacggtgcgggccgcggcggccagcctggggatggacagcgccacctttgttcgtaaacgccgcaagtttgaagagttgctgcaaaaatgaaacgggcgctgtaaaaatgcaccagcctacagaattgcggcaggtcaattggtttcagttagataagtttaaattaaccgatgatctcttgatgcagaaatgcagcaaacagggagagggatttctcgggggaaaagcccaatcaactgcgcggcagttgattgggccttttttttgaagttggcatgtgaaatgcataagagaaggagtgtcacgaacagttggccaactgtcgcagcgagactgacaaaactcctgtttgggatgagaaagagggaacgtaaatggcaaacgaacaatttgtcagccgttaccgtaaatacggtgaagaacagccctactggaaggccggtattttcaagatccgcctcccctttgtccactacaaatggtcggttcccgagatggtgcaggccgtgttcatgtgtgcgacctgcctgggcgctatccccgtgctgcaagaggtcctgggcgtttcgtacggtgtagccctgtccatggtcatcattaacggcttcttctacaacctgcatgtgttgctgggcgaccccgtggtgcccgggtggatcacccctgccattcccatcattaccgccttcctgaccgacggatatgagatgggccctgagcgtacccaggcgctgattgctatgcagttgattctgggccttatcttcctggtgttcggcatcaccggcatcggcggcaagatggtacacttggtgccaaactccgtaaaggccggcgtactgatgggcggcggcttagcggccatcatcggcgagatgggagaaaccggtcgtttctggacgtatcccatctctattaccgtgggtgtgctggtggcctacttctgcctgttcagtcccatatgggccaacctgcgccggaaatacaaggccattgatttaatcggcaagttcggtatgctgccggctatcatcatcggtgtcgttctgggccccattgtgaaggagatcgcggtgcctgctgttcagttgtggcccctcatcaagatcccagagttcggcaacatctggaaccagttgtctccctttgccatcggctggcccagcgcggcgacctggattgccgccatccccaccgctatcgtggtgtatatcattgcctttggcgacttcgtcacctcggaggagctgctccgctccgccgatgaggtccgccaggatgagaagattgacttcaacgccaaccgctccaacgtcatcagcggtatccggaacgtggccatggcgctgtgctgcccctacacccagacctgcggtcccctgtgggcggccgttactgccgctgtgtcccagcggtacaaggagggccccaaggccatggagtccatctactccggtgccggtaccttccgctggtgtacctttatttgcgtggccctgatccccatctcctccctgctacagcccgtgctgcctgtagccctgtccctgaccctgatcgtgcagggcttcatctgcacccagctggccatgaacatgtgccgcaccgacatcgagcggggtatctgcggcgtcatgggcgcggtgctggccatccagggtgccgcctggggactcgcagtgggtctgattctgttctttatgctttttgagggcaaaaagaaggcctccgagcaggtggccgtcggtgccgccgacgacaaggcgaaccagtagttccattgagttctgagtattcaaaaacatagattgattgaatctgattgagaaaggaagtcctctattatggcactcatgaccggcgaacagtacatcgaaagcatccgtaagatccccatggaaatctacatgttcggcaagaaggtggagaatccggtcgacaatccgatcctgcggccctccctgaacagcgtgcgtatgacctatgacctggcccagatgcccgagtatcaggagctgatgaccgccatctcccccgagaccggcgagcgcatcaaccgcttcacccatatccaccgctccaccgaagatctgcgcaacaaggtgaagatgcagcgcctgctgggccagaagaccgccgcctgcttccagcgctgcgtgggcatggacgccttcaacgccgagtactccaccacctatgagatcgacaagaagtacggcaccagctatcatgagaacttcaagaagttcatgctctactgccaggagaacgacctgaccgtggacggcgccatgaccgacgtcaagggcgaccgctccaaggccccccacgcccaggacgaccccgacatgttcctgcatgtggtggagcgccggcccgacggcgtggtggtctgcggcgccaaggcccaccagaccggcatcatcaacagccacgaggtcatcgtgatgcccacccagtccatgggccccgacgacaaggactacgccatctccttcgccgttcccctggacaccaagggcctgttcatgatcatcggtcgccagagctgcgacacccgcaagctggagggcagcgagatggacgtgggcaacagcgagttcggcggcgtggaggccctgaccgtgttcgaccacgtgttcgtgcccaacgaccgcatcttcatgaacggcgagacggagtacgccggcatgctggtggagcggttcgccggctatcaccgccagagctacggcggctgtaaggtgggcgtgggcgacgtgctcatcggcgccgccgccgtggccgccgactacaacggcgccaacaaggccagccacatcaaggataagctcatcgagatgacccacctaaacgagaccctgtactgctgcggcatcgcctgctccgccgagggcgcccccaccgagagcggcaactacatgatcgacctgctgctggccaacgtctgcaagcagaacgtgacccgcttcccctatgagatcgtccgtctggccgaggacatcgccggcggcctgatggtcaccgcccctggcgaggccgacttccgcgacgagaagctggggcccgtcatcgacaagtacctcaagggcgtgtccaccgtctccaccgagaaccgcctgcgcattctgcgcctcattgagaacctgtccctgggcaccgccgccgtcggctaccgcaccgagtccatgcacggtgccggctctccccaggcccagcgcatcatgatctcccgtcagggcaacctggcccacaagaaagagctggccaaggccatcgcccacatcaaggagtaagcaaaaaccatattcgaatcgcatctgtattcgaccggagggcggcggcaatccgccgccctccggctttgcaaaaggaggcatccgccatgtatgaggacatcgaggccgtgctggacgagcacgtgcgcccgctcctgcgcacccacggcggtgagatggagattattgaggtggaggacggcgtcgtccgcttcaagctcaagggcaagtgcgccggctgtccggcggccgacctgaccaccgaggagctgatccagaccgcgctgaccgagcacctcccgcacatcaagcgggcggtgctggtgcaggatatcagcccggagctgctggacgaggcccgctccatcctgaagatgcgccatggcggataaacggcagatcggcgtccgctactgcggcggctgtaatccccggtatgaccgggtggccctggtcaagcgcatcggcggctttttcccggaggcggagttcgtcaccgcccaggctggggtgaagtacccggcggtactggtggtgtgcggctgcccctcccgctgtgccaacgtcagcgatctggcagtgcccgccgggcggctgatctacctcagcggctgggaggagctgctgccggtgaaggagaagctggccgaggccctgaaggggcagcaggcgcggagcctgacccacgaggaggtgctggatatcctgccccaccgggagcccatgctgttcatcgacacggtgagccgcctggtgcccggggaggaggcggtggcctccttccgcgcccggccggagctgccctgcttcgcgggccacttccccggcacgccggtgctccccggcgtctacaccatcgaggccgccgcccaggcggcggacatcctgatgatgaccacggagcgctacgccgggaagctccccctgttcatgggggtgcgggaggccaccttccggcggaagattctgccgggggatacgctggaaatccacgtgtccctcctggaggagaaggcggagcgggccatcgccgcctgccgggggcaggtgtttgtggagggcgtgctggcggcggatctggagctgcggctggccttccggtagcccaataaaaaggagacaatgcaatgacatatgcaatcaaggccccggcccgctatgcgcagggcgcgggagagctggccaatctgggccgcagcgccaaaaagctgggggataagttccttgtgatctgctccgacaacagccgcgggcgcttcggcgcccaggtggaggccagcctggccgagcaggagaaggaggtggtgttcaccaccttccacggcgaggccaccaaggacgaggtctttgccaagatggacgagtgcagagcccagggctgcgatgtggtggtgggcatgggcggcggcaaggccctggacaccgccaaggccgtggcggaaaatctgggcctgccctgcgtcatcatccccaccgtggcctccaacgacgcgccctgctccggcgtggccgtgctctacaacgatgccggggtggttatcaaggccgtgctcatgcgccgcaacccggatctggttctggtcgataccggcatcatcgccaacgcccccaggcggctctttgccgccggcctgggcgacgcgctgtccacctggtttgaggcccgggcctgcaagaacagcggcgcccgcaccatggcccggggcaacgtgtccaacaccgggctgatgatggcccgcctctgctacgacctgctgatggagaaggggcgggacgccctggccgcggtggagcggcacgaggtcacccccgcgctggaggacgtggtggaggccacaatctacctcagcggcctgggctttgagaacggcggcctggccgccgcccacgccgtcaacgacggctttgcccaggagccccaggcccacggcatgtaccacggcgagaaggtggccttcggcaccctggttcagttggtgctggagaaggccccccaggaggagctggagcaggtgctcgcgttcctgcgggacaccggcctgcccctgaccctggcccagctcggggtgaaggagatcgtgccagagaccctgaaaaaggtggcggaggccgccgtggtgcccactcagtccaccaagaacctgcgcgccgatatcaccgcccaggaggtctacgacgccatcctggaggccgaccgcatcggccgggactatctggcacgctgagcccagtcttaaaatccaaagaatagagggtgtgtatcgtatgaattggaaggaatattacaagcagcacctgatgagcgcggaggatgcggtcaaccacatccagtcgggcaaccgggtggtggtggcccacgcctgcggcgagccgtcctatctgctggacgtgatggtggccaacgccaaggcctacaaggatgtggagatcgtccacatggtggccatgggcaaggccgagtactgcaagcccgagtatgccgataacttccgccacaacgccttctttgtgggcggaaccagccgggatgccatcgccgagggccggggcgacttcacccccagcttcttctttgaggtgccccgccagttcagctccactatgccggtggacgtggccatggtcatggtgacgcctcccgatgagaacggcatgtgctccctgggcgtgtcggtggactacaccctggaggccgtcaagcaggccaagctggtcatcgcccaggtgaacccccagatgccctggaccggcccctacagcctggtgtccgtcaaggatctggactgcatcgtggagcatgaggcccccatcattgagctcaagccccccaagatcggcgacattgagaaggccatcggagggcactgcgcctccctggtgcccgacggggccaccctacagttgggcatcggcgccatccccgacgccgtgctcctcttcctcaagcacaagaaggacctgggcatccactccgagatgttctccgacggcgtggtggagctggccgaggccggcgtcatcaccaacgccaaaaagaccctccaccccggcaagtttgaggtggcgttcctgatgggcacccgccgcctttacgacttcgtggatcacaaccccgacgtggagctgcgccctgtggactatgtcaacaacccctttgtcatcgcccagaacgagaacatggtgtccatcaactcctgcgtacaggtggatctgatgggccaggtggcctccgagagcatcggccccaagcagatctccggcgtgggcggccaggtggacttcgtccgcggcgcttccgccagcaagggcggcgtgtccatcatggccatgccctccaccgtcaagggcaaaatctccaagatcgtgccgctgctggatgagggcgccgccgtcaccaccagccgcaacgacgtggactacatcgtcaccgagtacggcgtggccgcgctgaagggccagaccctccgccagcgcgcccgcaacctcatcgaaattgcccaccccgacttccgcgacgagctcaaggcggagtacgagaagcgcttccactgcaagtattaagcggcatggggcgggccgaaggcccgccccatttggtacttacgccgcgggatagaaaggaaacgagctatgacaaatctggagaagtatgaccgcctgttcctcaccgccttccgggtcaagccggaggagctgcccggcctcaagtaccggggcatccccctgtgggactccctgggccacatggatctgatgggggacatggaggagaccttcaaaatcagcatcggcaccgccgacgtgctggatttctcctcctatgagaagggcaaggagattctggccaagtacggcgtggagctctgagccgtgctgcgtctggagcggtggacggagccgctggcggagagcaactgctatctgctgggggaggcggggcgcgcggtggtcatcgaccccaacgatcccagggggccgctggagcggctggaggcgctggggtggacgccggaacggatcctcctgacccacgagcactgcgaccacatggccgggctggaggcgctgcgaaaccgctggcccggggtgcgggtggcggccaccgccgcgtgcagcgccggcctgggggacacccggctcaacatgacccggaggatggaggtctatctcgccttccggggcaagccgggggtgtcctatccgcccttcgtctgccggccggcggatgagacctatgagcgcgcctgggagtacgtatggcggggacaccggctccgcgccgtggccctgcccggccacacgccggggagcgcgggaattttcctggacggggacacctttttctccggggactacctgattccgggggaggaggtcatcctccgcctgcccggcgggagcgagacggactaccgcgccgtcacggagcccattctccgggggctgccccccggcctgcgcatctgccccggccacggggagccctatattctcacaggaaaggagtgaagccggtgtggagctgaacacactgctgcaatacaagccctattccacggcccggacggagaagcgggcgctttacgccggactgctcaccgggctgacccagtttcaccgggagcgctgcccggagtacggccgcctgctggacgccctgggctgccccgcccacatggactgtacggtggagagcacccccatgctgccggtgtccctgttcaaggaactggagctgcggagcatcccggagggagaggtgttcaagaccattacgtcctccggtaccaccgggcagcgggtgtccaggatcttcctggacggggccacctccgcctgccagcagcaggccctctgccagatcatgtccgacttcctgggggagcggcggctgcccttcctggtgctggacagcaggcaggttctgcgtaaccgcgccatgttctccgcccggggggcgggcattctgggcttttctatcttcggcaccaggccctgctatgccctggacgagcacatggagctggatctggacggggtgcgggccttcctggaggagcaccagggggagaccatcttcctcttcggcttcaccttcatcatctggaagcatgtcgtccgcgccctggaggagcggggggagaggctggacatccccaacggcatcctggttcacggcggcggctggaagaagctggccggcgaggcggtgtcccccggggagttcaaggcccgggtggcggcggccaccggcgtggagcgggtgagcaactactacggcatggccgagcagaccggctgcatttacatggagtgcccccagggccacctccacgccagcctgtggtcggatatcgtggtgcggcgggggcgggactaccgcccctgtgagcctggggaggagggggtgctccaggtgctctccccgctgccccgctcctatcccggccactccctgctgaccgaggatctgggcgtgctgctgggggaggacgactgcccctgcgggcgcaagggcaaatatttcaaggtgacggggcgggtgccccgggccgaggtgagggggtgcagcgatacctatgagggataacgtcacgcttctggccggggcggagcaggtggacgccgccccctggctcccctttgaccccagggcggtggacttcctggcggagctgtccgccgaggtgctccgcggcccggacacccggcggcaggaggcctccgccgccttcggcttctggtgccgccgggcccgcctggaggccctggccgcgcgccacgcctccccgctgccccggctgggccgggggctggccttccatctggcccccgccaatgtgcccgccctgtttgcctacaccctggccatcggcctgctggcggggaacgccaacgtggtgcgcctgtccagccggcgggtggagggggaggcccccctgctggcggccctccgccgggtgctggagcggccggagcacgccgccgtgcgggcccgcaccagcctgatcacctacgggcgggacgatgccgtcacggcggactactgcgcccgctgcgacgcccggatcgtgtggggcggcgacgccacggtggcggcggtgcgggccatgcccatgcccccccacgccgtggagctgtgcttccccgaccgctggtcgctggcggtgttcagccagcgggccttctccgccctcacgccggaggagcggggggcgctggcccaccggttttataatgacacctaccagatggatcagaacgcctgctccagcccccagctggtgctgtggctggaggacgggggagaccccgcctgccgcggccggtggtgggaggcggtggccgccgaggcggcggagcgctaccccttcggccccttccaggcggcccgcaagctggagcggctgtgcctctgcgccatgaccatggaggagcccgccgtcgccgccgtggagcgctatcagggcaacctgctctatgtggcccggctggcggggctgtctggaaacctgccctccctggccgggggcttcgggctgttctttgaggcggacttgccccgtctggaggcgctggcccccctgctcccgcccaaggcgcagaccctggtgtgcggcgggctggagccgtcggagacggccgccctgctggcccgggcgggggcgcggggcgtggatcgggtggtgccgctggggcaggccctggagatggatacggtctgggacgggagggatctgatcgccgccctgtcccgcatcattggataggaggagcacatggaactgtttgcgcgctgcgaccgggagacggagcggctgctggccgtcaccgaggaggggaaacggtacaccctgggggatttgaacgccgccgcggagcggattgccggggccgtgggggagcaccggctggtctttgtgctgtgtgagaacacccccggaaccctgctgggctacctggggtgcctgaaagcgggagaagtgcccctgctgctggacgcccacattgcgccggagctgctgcgcggcctgctggagacctaccgccccgccttcgtccatgtgcccggcgacctcccggcggagacggggcgggtgctggagggctttgtcccggcgctggaggtggaggacagcgttctgctccgccgccccggcgggcaggggccggagctccacccggagctggccctcctgctcaccacctcgggcagcaccggcagccccaagctggtgcgcctcagcggccggaacctggatgccaacacccgctccatcgtggagtacctggagctggacgagggccagcggcccgtcaccaacctggccatgagctactcctacggcatgtccatcgtcaacacccacctgctggcgggggcggcactggtgctcacccggcgcagcgtgctggagcggcccttctgggagctggtggagcgggagcgggtcacctccctggccggggtgccctacacctaccgcatgtaccggcgggcgggcctgctggagatggagctgcctgcgctgaacaccctgacccaggcgggcggcaagctgccggaggcccttcacctggagtttgccgactgggcggcgcggacgggacggcgcttttttgtcatgtacggccagaccgaggcggccccccgtatgggctacctgcccgccgagcgggcggtggagaagtgcggcagcatgggggtgccggtgcccggcggccagttccgcctgctgggggaggacggcgcgcccattgacgcgccggacaccgtgggcgagctggtctaccgcgggccaaacgtggccatgggctacgcccggcgggcggaggagctggccctgggggacgagtggcacggggagctccacaccggcgatatggcccggcgggacggggacggcttctactacatcgtgggccgcaagaagcggtttatcaagctctacggcaaccgggtgggcctggacgaggtggagcggctgcttgccgcccgcttcccggacacgggctttgcctgcgtggggcgggacgacctcctccgggtctttcacgacagccccgatcccgccgtgaccggggcggcggcggagtatctcagcgaacagatgcacttcccggagcgggtctttcagatccgggccttggaggccattcccaagaatgaggcgggcaagacccagtacagggcgctggaggagatgcggtaacaccggccgaagtatgctgcatatgagtcgggccgccgggaattcccggcggcccggcttgtatttttcagggagctgtgctatgctgggaccacggaacaaaagagaagcccggctcagacgccggagccggccgcgaatcgcggccggtcccgcagactcacgcgtattcgcttcgctccgccgaagcgccgcagcggtatttcagcacacctgcggtgtgcagggggataccgccgcgccgttcgccatacagcaggttttgttccgaaccgggaagggaggggcggccatgggaatcgtctatcaagagggcccctccctggcccgggacctggggcttcccctccgcaccctgtatgccgtcagcaaccggattccagcccactaccaccgggcggaggttcccaagcgggacggcggagtgcgggtgctccgggtgccggaccctgtgctcaaggacatccagcggcgcatcgcccgggtgctgctctcgggcatgcccgtgtcgccccatgccaccgcctaccgatacggcgcgggggtggtggagaatgcccggcggcatgtgggccgcccgagctgctgaagctggacattttgcactttttcgacagtatccgctatattcaggtgaaggaggcggccttcccggcggagatctacgccgagccgcaggagcagtgcctgcggcgcttgctggggcaggtggacttttggctccaggcccagccggacagccaggaggcggcggagtaccgccgttggctgctggacgagatgcgggatgggcgttaagcggggagggcatatgggaaacggggtgctcctgaatgcggcgatgtgatggcttcctactgcttgtgatatttctataaaatatacatttttcttgtggcgaagacggaagtatattataataaacatatatcttttctatgataaaaagacctacccatatcaattgaatggaggaaaacctatgtaccaggtctccaattttaccgagaatgatgacgtaaaagtgctctctgagttgggtgcctttcagatcattgaataccagcgggatttgagcgtttcgccgtcctctgcagtaacggcctacttcagcgcacagatgaacgtcaaaaagcgccaactggtatgccatctgcacaagtcccatgtgaccattcaggcgggtgccatgcagtggatgctgggcaacgtgaacgccaccaccggcattaagggcgtgggggacttcctggggaaggcggtgcgcggcaaggccagtggtgagtctgcaattaagccggagtacaccggcgacggactgctggtgctggagccaacctataagcaccttattttgatggacgctgccgactggggtgggagcgtcgtgctggacgacggcctgtttctggcctgtgagtccagcctgcagcacaaggcggtcatgcgctccaacctttcctccgcggtggctggcggcgaggggctgtttaacctgagcctcaacggcagcggcatattctgtatcgagtccgactgtcccaagggggaattgatcgagatcaccctccagaacgatgtactgaaggtggacggcaactatgcaattgcctggagtaagagcctggacttcaccgtggagcgctccggtaagagcctaatcggctcggccgcctctggtgagggccttgtgaacgtataccgtggtaccggaaaggtgctgatgatgcccactgcaaagatgcccaatatctgagcggatgccaggccttgggccccagggattaacaaaggtttgggccgccccttgtatatagggtgcggctatccactgggtgactaagtaagtactgcgccgcccgtctgtgtcgttccgggggctgactgaggcggacggcccggagggggagaggcccctgcccgccccggcggaggagccggagggcgtcaccgtcaccgacacctccggatactaccgcatgaccttctgccctgggaatctggtctactactacatggatgactattggaatttctggttccaggggacgggagaggcggagctctacccgctcctgctggagcagacggcatagacgtaaaagcgccgggcggccttggccgcccggcgttttatctattttgtcctatttgtccgccatgcgcttcaccgcccggacggtgagggtgtccccgtccacggtgaagcggatgttgaccccggcgaagtccagcccgtatacccgctccggatcgtgctggtagggggggcgggggtcgcgggagagcacgccggtgagggcggcccgcttgtccgcgggcacccgctccagcagggcggcgggaaagtccaccgccagggtggccccgccgccgctgccggtaaagccgccgctggcctccgggcggcagtcggcataggggatgtagggcttgatgtccagaatgggggtgccgtccatcagatcggccccggagacctccagcacatggcccagctccggctctctccggatgccctccagccgcacgcaggacaggccgatggggttgggccggaagggcgagcgggtggcgaacacccccatgcgggtgttgccccccagccgggggggccgcaccgtgggagaccacttgtcccgcacggcctcggagaactgccagatgagccagaggtgggagaagtcctccagcccccgcagcgcgtcggggctgcggtattccggctcgaagaccacggtggcccgcagctcctccaccaggccgctctggcggggtatgccgaacttggtgggaaagtcgctgcggatggtggcgatgatttccatggggatcatggcttgtcctcctgtctgcgccgggccctctccagggcggcggccaccggctgggagggggcggaacggttgttggccgccagaatggcggagatctggccggcggcctgctccacctcggccttgaaggcggaggccgacagccgcagggcgccgtggcccaggatgatgagctgctcggccccgtcggaggtggccacccgcacccggtggtgcctcccgatctcgtaggtggcccgctcaatgtaggtgtccgccgtctcggcctccttggtgtagaccacgtagatgttgtggtacttcgtcacgtcctggacgctgcggggcaccctgtaggcgtcgaacaccagaatgacgatattctgcttgaagccctggtagttgctgagcacctccatgagcatctgccgggcggcgtccaggttgtcccgggccaccgccttcagctcctcccaggcgaagatgaggttgtagccgtccgccagcaggtattccggcccctgcttctgggcctggatggagtacttccggtcgtccaggctggtgcgggcgggcttgggctgggggcggaaggcgccccgctctaccttgccgtaggtgcgctcgaagatggcctggagctccttgtcctgctccagggaggcggcgtaggacacgctgcggggccggacgggggcggcctcctccggcgggggcggctccgcccccaggcgcaggccgctgcccacgtgggcgtgggccttgacctcgctccacttcacgttgtagcccgccccgtgggcgcagaacaccgagtccgccgggttgtccacgtcccgctccgggtcgtagcccagagcggcgatcacctcatcggcgttgtggcagggggcgtagccgccggcggtgcagctcagccgtccccggccacgggtgtaggcggccacctcccggccatagtcccgcaggcccgccaccggggcggagccggtgagcacgctcagcgccccggcggtctccggcgtgccggcctgcccgcccatgcgctggaggtcggacagggcccggcccacctgctccgggggcagctccagccggaagtcgtaccacggctccagcaggatgctctccgcctccatgaggccctggcgcaccgcccggtaggtggcctgccggaagtcgcccccctcggtgtgcttaaggtgggcccgccccgccaccagggtgatgcgcacatcggtgatgggggagccggtgagcacccccaggtggggcttctccgccagatgggtgagcaccagccgctgccagttcccgtccagcatgtcctgggggcaggcggcggccagctccaggccgctcccccgggggagcggctccagcagcaggtgaacctcggcatagtggcgcaggggctcgtagtggcccacgccctccaccggggcggcgatggtctcccggtagacgatgccgccggggccgaaggtgatcgccaggccgaagcgctgggccgccagcgcctggagaatctccagctgaacctcccccatgagctggatgtggatctcccgcagccgctcgttccacacgaggtggagctggggatcctcctcctccagcaggcggagcttgcccagggcggcgtggggatcctgcccctcggggaggagcacctggtaggtgagcaccggctccagggcggggggcagggcctccgcctctgccccaaggccctccccggcggcggtgcggctcaggccggtgacggccaccacgcttcccgcttgggcctcgtccacggtctggaacctggaccccgagtagacgcgcagctgatccgccttctccgtccagccggggccggagagggcctccttcacccgcagggcgccgccggtgagcttcatccacgtcaggcggttcccctggttgtcccgggaaatcttgaacacccgggcggcaaaatcggggccataccggggccggggggcgtacgccaccagcccctggaggaattcggccaccccctccagcttcagggcggagccgaaccagcaggggaagagcctccgccgggcgataagggcggtgagggtatcgccgtccagcgccccgtcctccagatagcgctccagcgcgtcctcgccgcagagggcggccgcctcgtcccgctccgccgccggggcggtgaagtccacgcacccctcgtccagcccggctttcagccccgccagcagggcggccttgtccgcccccgccagatccatcttgttgacaaacaggaaggtgggcacgccgtagcgctccagcagccgccagagggtgtgggtgtggccctgcacgccgtcggtgccgctgatgaccaggatggcgcagtccagcacctggagggtgcgctccatctcgctggaaaagtccgcgtgacccggcgtgtccagcagggtgagctccgccccgtccacagggagcaccgcttgcttggaaaagatagtaatgccccgggcgcgctccatggggtcggtgtccagaaaggcgtcctggtgatccacccgccccagctttttcaggcgcccgcaggtgtagagcagcccctcgctgagggtggttttccccgcgtccacatgggccagaatgcctacaaccagtttgtccatagctgccgtcctttacggtgtgatactatagtatagcacgtccggggcggacggggcaacaaacttcatgggcttaaagcgcaccacgggcccaggcaaacgccggtgcgcaggaagcttttgcgcatgtgggccgtcctggcccacgggctgttgcgttcatggccgcgccaccgaaagcggcacacggccctttttgctatacctttgcatagtaaaaagggccccgaagggccctctggaggggaaatcagcccttggcccccgcgctcatataggagccgtacagcggggtgggcaggccgaagccgccggccacgggcagaatctcgccggtgatgaaggcggcccggtcgctggccaggaaggcgacggcatcagcgatgtcctccgggcggccggggcggttgagggggacgtttttcaggaaaagatccaggaaggcctgggacatgttgttcagagcggcgtcggtggcggtgaagccggggagcaccgcgttgcaccgcaccccctgccgggcatactgcacggcgatgtccttggtgaggaagtggatggccgccttgctgacgccataggccgtgcggctcagatcggggtagaggccgcccacggagccgatgttgatgatggagccgccgccgtttttggccatgaggggcaccgccgccttgctgggcagatacacgctcttgaggttggtgttgacgatgcggaagaagtcctctgaggggccgttcaccacgtccaggtcggtcttgacgtcggtggagccgaagttgttcaccagaatgtccagccggccctccttggccgccacctcgtccaccatgccggaaaagctctcctcccgggaggcgtcaaagaagaccaccccggcccgcccgccggcggcaatcagctcgtcggcgatctgctgtccggcctccaggcggcggaccccgagatagaccgcggccccctgggcggccagcgtcttggcgcaggccaggccgatgccgcgggtggaggaggagaccagagcgaccttgttttcgagttctttcatgcttattctccttttcaaaccgattagtatagatatgatactgtgatgatagcacttaagaacccaaatgacaagcgttaattttttgacgtatgcagcaagaaaggaggccctgggaaccggaaggttcccagggcctcctgctgtactgccgttacaggcactcgaagatacctgccgcgcccatgccgccgccgatgcacatggtgaccatgccgtaacggccgccggtgcgctccagatagcttaaggccttacaggtgagcatggcgccggtggcgcccagggggtggcccagggccatggcgccgccccaggggttgaccctggccgggtccatgcccagggtgcggatgaccgccagggcctgggaggcaaaggcctcgttgagctcaatggtgtccatctgctccagggtaaggccggcctttctgagcgccttgggcaccgcctcgatggggccgacgcccatgacctccgcaggcacgccgccggtggcaaaggagacaaagcgggccaggggcttcacgcccagctctgcggctttttcctccgacatgagcaccacgaagccggcaccgtcggtcatctgggaggaggtggctgcggtgacggagccgttttccaggaagcagggcttcagcccggccagcgtctccgcagtggtgccggggcggatgccctcgtcccggcagaccaccacctcgccgccgtcggggccggggacggtgatggggatgatctgtccgtcaaagcagccgccggcctgggcctgggcggcccggcggtggctctcaacggccatggcgtccatatcggcccggctgatgccccactggcgggccacattttccgccgtgatgcccatggtggtgtatacctcggggcggtgctccgccagccaggggtcggcatcctccgcgcccaccagcatgggaaccagagacatggactccacgccgccggcgatgaccacgtcctcctccccgcagcggatggcgttggcggcggtggcgatggtctgcaggccggaggagcagtagcggttgacggtctgggcggtgacgcagtcgggcagcccggcccgctggacaatcagccgggccatattgccgccctggacaccgaagggcatggcacagcccatgatcacgtcgccgatgtcctccggccggagctggggtactctggccagcacacccagaagggtctgggcgccatactccacggggtggagctgggcaaaggagcccttgcgggccttgcagtagggggtgcggccgaaggcgacaaccacggcctgtctcagttgtgtctgcatggtaatgttcctctcctcagtctgtctattttaattggtattgttccattttttcgtagagcactgtgcgggagatgtccagaagcgcggcggccttgacccggtttcctccggcggcggccagggcgtcccgaataagctcccgctcaaaggcctggcgggcggggcgcagcttgaagtcccccggcccggtgagctggcgccgccgccgggcctgcatccgctgctccagttggcggaagtcccgccgccgcaggatgggggagtcagccgcgttcatggcgctctccaccgcgttctgcagctcgcggacgttgcccggccagtcgtaatccatcagcaggtccatggcgccgggggccaccccctcgatgaccatgccgagctggtagttgagccggtggataaagttgtccacaagcaggggcagatcctccttccgctcccgcagggtgggggcctggatgcggatgacgttgaggcggtaatagaggtcgctgcggaattgtcccgcctccaccagcgtctccagcgggatattggaggcggcgatcacccgcacgtcgatgggaatgctcttctccccgcccaccgggtcgatctccatctcctgaagtacccggagaaacttgggctgcatggtggcggtgagcaggttgacctcgtcgagaaaaatggagccgccgctggcgagctgaaagcggccgatgcggcccttccgggccgcgccggtgaaggcgccggcggcgtagccgaagaactcggactccatcagctcggccggaatcgcggagcagttgacccgcacaaagttggccgccttgcgggcgttcatggcgtggatagagtgggcgatgagctccttgccgctgcccgtctccccctcaatgagcaccgtggaggtggagcgggcggcctggacgatctgctccttcaggcggaggaccgaggcgctttcgccgatgatgttgtccagtccgtagcgtgcgccccgctcccgggacagctcctgctggtagaactccaccttgctggacagctcgccgatgcgccgggtcaggttctgagcgtcctccataccctggacgatgacatagagaaacagcccgcacagcttcccatcccggtcaaagcggggaaaataggaggtaaaggcggggccgttggcgttgacggccttggcaaagaccggcttgcccgtgtggaagacctcggtggcgtgggtgtcgggcaccatttcccaaaccttccggccgatggcctcctgtgcggtgtggccggtgtagcgctcccagcccgggctgacataggtgtagacgccgtcctggtccagaaccgccatggcggccagaccctcgataaattccagcatggtgctcggatcaatgtggttttccaatgcggcttcctccactcatacacggtacggaatgtattaacgatagcaagctgcgcgccgttttacaatggttaatttcaccgaaaatgaatctttttgtttagttgatgcggagaaaatgggtttttgcaaaaaattgagtcacaaaaaacgccagaaaacgtccaaaattgtttgcgaaatgtacggaaaacaaaacatgtaaggaaatcaatacatgaggcttaaaacataagaacagagggggattgccaaaagacagctcaaaataaaatattcaaatgtacggattaccgaacagtgtttgggcgcctggatgtcaatgaaaataaccgctttttcttacagttgcaacggcttgcagagtattagacagacttggcacagaaattgctatcttatgagacgcaagcaacggccaccggccgaatcaaaaggagtgtaaccactatgaaaatcattgacctgtctattcccattgaagacggactgcccagtgatcccccgatccagattcccaagattcagtattgcaaccacaaggacaccgcggagcagatggctggcttctttaagggctgcaccgttgaggatctgccggagggcaacggctggggaatcgagttcctgcaggtgtgcacccattccggaacccatgtggatgccccctaccactattaccccaccatgaacggcggtgagcgggcctggaccattgacgaggtgcctctggactggtttgtgggcgacggcgtggtgatggacttccacgacaagcccgatggatacaagatcaccgccaaggatgtggaggagtacttccagaagatcaactacaccctcaagcccggcgatattgtcttcctgcgcaccgacgccgatgaccgctggggcaagcctgagtacttggttgcgggcgcgggcatgagctatgaggccactatgtggctgctggagcgcggcgtgcgtgtggtgggcaccgacggctggagctgggatgtgcccctgcccttcgagggggaggagtttgaaaagaaccacgatgcctccattatctgggaggcccaccgggtgggccgcgacaaggcctactgccacatcgaaaagctgaccaacctggatcagctccctgtcaccggctttaaggtaagctgcttcccggtaagcatcaaggccgcctccgccggctgggcccgtgtggtggccttcgtggagtaacccttttgttgtgtcagtgtaaacaaccatacatatgaaagagagggacaaacgtgggtaacgtcatatttgtcgtcatatttgtcattttctgcgcgtttctattgggcgcaggcctgatcagcaagcggtgggtcaaggagtcctccgacttcgtgctggccggccgtgagatttccacccccatcaacgtggtgggcgtcattgctatcggctttgccggcaccacggtcacactggcccccggcttcacgattcagtacggcctgctgggcggcctgggttggggtgtcatctactcggtgtgcggcctgctgatcttcggcctgctgtactccaactttgtccgccgcagcggcgcccagaccctgcccgagtttctggagatgcgctacgacgggcacacccgttccgtagtggccatcacctccgttatcggcatgtgcggcattatggccaataacgtggtgtccagtgtggacaacattgcggccttcaccggctggaaccgcctggccattaccgctattatcttcgctgtcatcatcgtgtttacctttgtctccggcctgtgggccaccaccatcaccgacctgttccaggtgctcatcggcgtgattgtggtgcccgccaccttcttcatcctggccggacgattcggctggctggacgccatcagcgccaactggggtgccggcgacttcatgagccagggctttgtgggggcgctgcccggcatgaagctgacctacccctcggtgtttaacttcattatctgcttcgccgtagccctggtttggggcaacaactactactggatgaaggtcgccaactgccgcagtgagaaggtggcccgccgctccttcgtggccgctgccatcatcctgattgtggtgttcatggtgcccctgtgcttcatcggcggctacatgggcgcgttctatcccgagcagctcaccctcaacggcggtaccgtggctcctaccggcacctacggctatgtggccaagaccttcgtgtctctgtttggctccctggtggttatcagcgccgtggcggcatccatctctaccgcctccacctccgccctgggcgcctccgctgtggccaaccgcgatatctaccagcgcctgatcaaccccaaggctgacgcaaagaagagcctgaagatgtccaagatcatcatgctgctcatcggcgtggtcaccttcgtgctctgccagttccccggcggccccacctacctgttcgcctttgccaactgctggctggtgccccccgccattttgctgggcctgggcgccatctggccccggtttaacggccgcggcgccctgtggggcgcggtgtgcggcatggccaccatggctgtgttcaccctgctggacctgaccaaggtgttctccatcaacagctatgtgtatctggccaccctgggcctggtggtcaccctggtggtggcggtgatcgcctccctgttcggccagcccaagtattacggccgccccggctgggagcgggtgcccaccgcctccaaccgtaaggaggtcaagctgggcgagttggaaaagcagattctggagatgctgcgcatcggccactgctacatgtccgacctgaccgacgccctgggggtggactccaagacctccggcgccgccgtggagaacctggatcagggcggctacctggtccgtgccggcatgagcggctccaagttctacacctttaccatcaccgagaaggggctggcggccctgcccgccctcagcgggaaggaggccgagatggcagaggagttcctgaaccccctgtatgtccagctcctgaaggtggtcaaggagaaccccgagcagcaggcggagtttgtgcagagaaacggcattaagtccatgcgcatgtccgcaatctgctcccacctgacccgccgcggctacgtggtggagggcggcctgttcaagcgcaagctgcgcatcaccgagaagggcgccgctgcgcttcagaagtacgcgtaattctcctgtctgaatcaatcttcagagggcggggcagcctggctgccccgccctctgtgcaagaaaaggagtgctttcccatgtttgaggcggaatatgcccgccggcgcaccaccgcggaggcggaggcaggccgcatctgctccggggacaccgtctatctggcgggcggcccgttgctcccagtggactttgccgccgccctccaccggcgggcggcggagctccacggggtacgggtgctcaactacctgcccctggagcccctggctctgcttaccgaccccgcctgcggggacgcctttcaaattgagtcgattttttacaacacctaccagcaggaggcccagcgcctgggccgctgcgcctttctgcccaaccacctgcgcaatgcggccagggactggacccatggggcgccggagtacgactgcctggtactcacggtctcccctatggacaagcatggctgcttttccctggcgggctcggcctgcattgagctggaggtgctcccccgcgcccggcgggtggtggtggaggtggcctcccgtgctccccggatcttcggggacgtgaccctccatgtctcccaggtggacgccattgtggagtccgaccgctaccccgccgccctttcaccccagccccccgatgaggtggaccgccagcttggccgggtggtggcggagctggtggaggacggggccaccatccagctcggctttgggggtaccatcaacgccttggccgccgagctcaaggacaagcggggactgggtattcacaccgaggccatgtctgacgcggccatggagctgctccggtgcggcgcggcggacaacagccgcaagagcctccaccggggcaagacggtgacgtgctttaccatgggcagccatgccctctatgatttcgtggatgacaaccccaccatcctccacaaggccctgagctacaccaacgatctgtctgttttggcggccaaccggggcatgacctccatcaatgctgcgctccaggtggatctcaccggccagtgcgcctcggagagtgtgggaccccggcagatctcgggcagcggcggacaggtggacaccgccgtaggcgcacagatggcgccggggggcaagtcggttattaccctgcgctccacctactctgcaaaggacccggacacgggggagcggcgtctccagtcccgtatactgccggtactgccggagggggccgtggtgacccttacccggagcaatacccactttgtggccaccgagtatggcgcggtctgtttgcgggggctgacggttccgcagcgggccaaggcacttatctccatcgcccacccggactttcgggattggctggaggaggagtttcaccgcatctaccgcctgtgacggtccgtccgtatgtggaaacagagagcagccccggaaccgacgggttccggggccgctgaggctatcgataaaccttccgggtgaaggtttcggagggaaagatagtgtgaaagaaaaccgtcagggttgtctttcgcgtttggtcaaccgactttttgaaacttcaaaaggtttcaaaaagtccctcagcctgtcgaaaagactttttcgacaggctgagcagccccggaaccaaagggttccggggctgctctctttgtgaaggttattggtactgagcccagtttcccgcaggctggaggccggtccaggtttcatggacagtgtcggccttgcgctcgtagtcgtggctgttggtggcctcctggaccgccagatagtaccaggcatccggcgggttgtcgggccaggcgatcatgtcgtccagcagatcatccgcggtctcggggaggcggcccaggacgcggttgatggtggtcatggcctcggcgcgggtgatgctgcggtcgggggcgaaggaaccgtcaggctggccctccacccagcccttcaccgcggcctggttgatgtacccggcggcccagtggccggagatgtcggagaagcggtcgtcgctgtggtagggggcgctgtcaaagcgggcggcgatggcagcgaactcgccccgggtgatgggcgcctcgggatggaaggcggaggggctgcggccctccacgatgcccatggcctgcatggtggccacagcggtggcgtaccacgcgtcggaggccacgtcggcaaaggggctggtcccggtcaggtactcgtcccgggcctcgtcagtgagcagacggaagaagatggtggccacctcagcgcgggtaatgggggcctcagggtgaaccaggccgtcgtcccggccgatgatgtaggcgaaatgctcgtctccattgagccggtcgggcacgccggtcctttcccagccggcgtacacggtcttgttggaggtcatgcggatgtcgtcgatgggctcggtcagggccttgtcggcgtaccagccggtaaaggtgtagccctcccggacgggctccttgtccagctccaccagagtattgcggcggtaccgctcgtccttgtatttggtgccgccattgctctcatagagcagggtgtagtaggtggtgccaccaccgccgccgtggtccccgccgccggactccttctgatagaccagcgcgaagggggagaagctgccggtggcaaacttgatatactgtttgccgttcagggttaccagtgtgccgtccagcttctccgcaggattctccttcagttgttcgtccgccgcgccctcgtagtcgcggtcgagcgcgtcaaagtggacgatatagaagggcgcagaggtgtcggcgtcgtcgggcaccggccagtagagatctatcgtctggccgtcgcccagggtcacataggcgttgccgttgctgctgtccaccagatccaggtattggaactcgtagagatagtcgccgttggggatgccggtatcagacccgatgatttcattgctgatgtgatcaatgagcacctggtcgtccagcacttcgtcggtcagcaggtggacggcgttcttgtcggtgatctccacctggctgtcgttgacgtagtacgtaacgtccgccggggccaccgcggtgatggcgtcccccgtcacatcgtctgccttgtcctccaccggggcagtgacgccctcctttgtcgcaccgcgaatggtgagggcgccttcttcaatcttgaccgggtaggtaaatgtctcgtcggaatgttcgggaatatctttgaacaccgcctttacgaggtcctgatccaccccgccggagtagatggtcatggagtaggtcctgttctgctcgatggcagagacttcgaattcgtcgctgatcttgacttccccggtctctggatccgtaaactggagccgaacgggatcctggccttcctttaccgattccatccggtagatataacgggcgattccgtccaccgggtcggtggtgctggtagcgccgccgctgtaaagctgaatatcccaggcccggacggtttcgccggcgccataggtaaaggtcaggtgaccggcgaggtcaaccgcctgtccagggccttccagcatatcgttaatctcctccgggacggtgagcagatagcctgcctcaggcaggccgctgccgctgacaatctggccgttctcgtccgtgacgccgtcatagctgttgccgccggtgtaaaccgtaatgtccgccgggcggatggtgacatactgggtctggtcgacaaaccactcgtgggtgatgtcggactcgtctgttaccgctcggtcatccgtgaagtattccttggcctgaccggcctcggagacggcaaagtcaacctttgcagacggctctgtgtatactgttccctgcttgaggaacacatcgcccttgacgtagtccgcatcggccgcgccgttatccttagtggggacataggccgcgccctcctgcacggtgacattgctgcccccagtcaaatagcagatatctgcttctgcgctgatcggcgcaggcattttcaatgtgcctgcacaagtgaagtttccggaaatctcgttgctttgcagcagatccagcgcgccgccctcttgaatggtgacagtctccacgccgtcaaacagcgtctcgccggaggcgagatgctcgcgcaggatgccgccgtcctcaattacaacctcagggaacccgtggattccggtagaggtgtaatcgcctttgacgatgacgctggcgccgtttcctgtacgggtgggggtgtttttctcatagttataaaggtgctggcccagcttggaatcaccccgaactgcgccgcttagctcgtcagtgtcgtccaggataatcgtaaccgtatggtcggaggtcacttcgccaaacttgtccagtgtgtatacgttggcccggctgccgtgcagagtaatggagacgttgccgtcaacttgggccgggttatcctcgtcctcccctttaccggtcgcaaaaatggtcgggcaggcggattgggggccaccggatactgtgattacgacatcgccgatcacgtccgcaccttcattgcctccagcgcggatctcaccgatcacctcactgctgtcatccacggtgattgtaac
